(12) United States Patent
Bourgeron et al.

(10) Patent No.: US 7,384,740 B2
(45) Date of Patent: Jun. 10, 2008

(54) POLYNUCLEOTIDE AND PROTEIN INVOLVED IN SYNAPTOGENESIS VARIANTS THEREOF AND THEIR THERAPEUTIC AND DIAGNOSTIC USES

(75) Inventors: Thomas Bourgeron, Paris (FR); Stephane Jamain, Paris (FR); Helene Quach, Lognes (FR); Catalina Betancur, Paris (FR); Marion Leboyer, Paris (FR); Christopher Gillberg, Gothenburg (SE)

(73) Assignees: Institut National de la Sante et de la Recherche Medicale (Inserm), Paris (FR); Institut Pasteur, Paris (FR); Assistance Publique-Hopitaux de Paris, Paris (FR)

( * ) Notice: Subject to any disclaimer, the term of this patent is extended or adjusted under 35 U.S.C. 154(b) by 225 days.

(21) Appl. No.: 10/496,011

(22) PCT Filed: Dec. 2, 2002

(86) PCT No.: PCT/FR02/04134

§ 371 (c)(1),
(2), (4) Date: May 28, 2004

(87) PCT Pub. No.: WO03/045998

PCT Pub. Date: Jun. 5, 2003

(65) Prior Publication Data

US 2005/0118588 A1 Jun. 2, 2005

(30) Foreign Application Priority Data

Nov. 30, 2001 (CA) .................................. 2364106

(51) Int. Cl.
*C12Q 1/68* (2006.01)
*G01N 33/53* (2006.01)
*C07H 21/00* (2006.01)

(52) U.S. Cl. .................... 435/6; 435/7.1; 435/91.2; 536/23.5; 530/350

(58) Field of Classification Search ...................... None
See application file for complete search history.

(56) References Cited

FOREIGN PATENT DOCUMENTS

WO          99/55915          11/1999

OTHER PUBLICATIONS

Abdolmaleky HM et al. Genetics and epigenetics in major psychiatric disorders: dilemmas, achievements, applications, and future scope. Am J. Pharmacogenomics, 2005; 5(3): 149-160.*
Cline H. Synaptogenesis: A balancing act between excitation and inhibition. Curr Biol. 2004; 15(6): R203-R205.*
Dean C & Dresbach T. Neuroligins and neurexins: Linking cell adhesion, synapse formation and cognitive function. Trends Neurosci, 2006; 29(1): 21-29.*

Gauthier J et al. NLGN3/NLSG4 Gene mutations are not responsible for autism in the Quebec population. Am J Med Genet B Neuropsychiatric Genet, 2005; 132(1): 74-75.*
Grifman M et al. Functional redundancy of acetylcholinesterase and neuroligin in mammalian neuritogenesis. PNAS USA, 1998; 95: 13935-13940.*
Vincent JB et al. Mutation screenin of X-chromosome neuroligin genes: No mutations in 196 probands. Am J Med Genet B Neuropsychiatric Genet. 2004; 129B: 82-84.*
Ylisaukko-oja T et al. Analysis of four neuroligin genes as candidates for autism. Eur J Human Genetics, 2005; 13: 1285-1292.*
Anne Philippe, et al., "Genome-wide scan for autism susceptibility genes",Human Molecular Genetics, vol. 8, No. 5, pp. 805-812 1999.
N. Simon Thomas, et al., "Xp deletions associated with autism in three females", Hum. Genet, vol. 104, pp. 43-48 1999.
Jeff Milunsky, et al., "Schizophrenia susceptibility gene locus at Xp22.3", Clinical Genetics, vol. 55, pp. 455-460 1999.
Peter Scheiffele, et al., "Neuroligin expressed in nonneuronal cells triggers presynaptic development in contacting axons", Cell, vol. 101, pp. 657-669 Jun. 9, 2000.
Konstantin Ichtchenko, et al.,"Neuroligin 1: A splice site-specific ligand for β-neurexins", Cell, vol. 81, pp. 435-443 May 5, 1995.
Konstantin Ichtchenko, et al.,"Structures, alternative splicing, and neurexin binding of multiple neuroligins", The Journal of Biological Chemistry, vol. 271, No. 5, pp. 2676-2682 Feb. 2, 1996.
Marc F. Bolliger, et al., "Identification of a novel neuroligin in humans which binds to PSD-95 and has a widespread expression", Biochem. J. vol. 356, pp. 581-588 2001.
Mirta Grifman, et al.,"Functional redundancy of acetylcholinesterase and neuroligin in mammalian neuritogenesis", Proc. Natl. Acad. Sci. USA, vol. 95, pp. 13935-13940 1998.
M. Irie, et al.,"Binding of neuroligins to PSD-95", Science, vol. 277, pp. 1511-1515 Sep. 5, 1997.
Kazuyo Hirao, et al.,"A novel multiple PDZ domain-containing molecule interacting with N-methyl-d-aspartate receptors and neuronal cell adhesion proteins", The Journal of Biological Chemistry, vol. 273, No. 33, pp. 21105-21110 Aug. 14, 1998.
Cornelia Kurschner, et al.,"CIPP, a novel multivalent PDZ domain protein, selectively interacts with Kir4.0 family members, NMDA receptor subunits, neurexins, and neuroligins", Molecular and Cellular Neuroscience, vol. 11, No. 3, pp. 161-172 1998.
Kazuhiko Toyooka, et al.,"Selective reduction of a PDZ protein, SAP-97, in the prefrontal cortex of patients with chronic schizophrenia", Journal of Neurochemistry, vol. 83, No. 4, pp. 797-806 2002.
G. Köhler, et al., "Continuous cultures of fused cells secreting antibody of predefined specificity", Nature, vol. 256, pp. 495-497 Aug. 7, 1975.

(Continued)

*Primary Examiner*—Eileen B. O'Hara
*Assistant Examiner*—Kimberly A. Ballard
(74) *Attorney, Agent, or Firm*—Oblon, Spivak, McClelland, Maier & Neustadt, P.C.

(57) ABSTRACT

The present invention provides a method of diagnosing autism linked to a mutation in the polynucleotide of SEQ ID NO: 12 or the polypeptide of SEQ ID NO: 14, or a propensity therefor, in a human, where the mutation results in altered synapse formation.

15 Claims, 155 Drawing Sheets

OTHER PUBLICATIONS

2003 Nature Publishing Group, vol. 34, pp. 27-29, "Mutations of the X-linked genes encoding neuroligins NLGN3 and NLGN4 are associated with autism".

Robert A Philibert, et al., / Gene 246 (2000) pp. 303-310, "The structure and expression of the human *neuroligin-3 gene*".

* cited by examiner

FIGURE 2

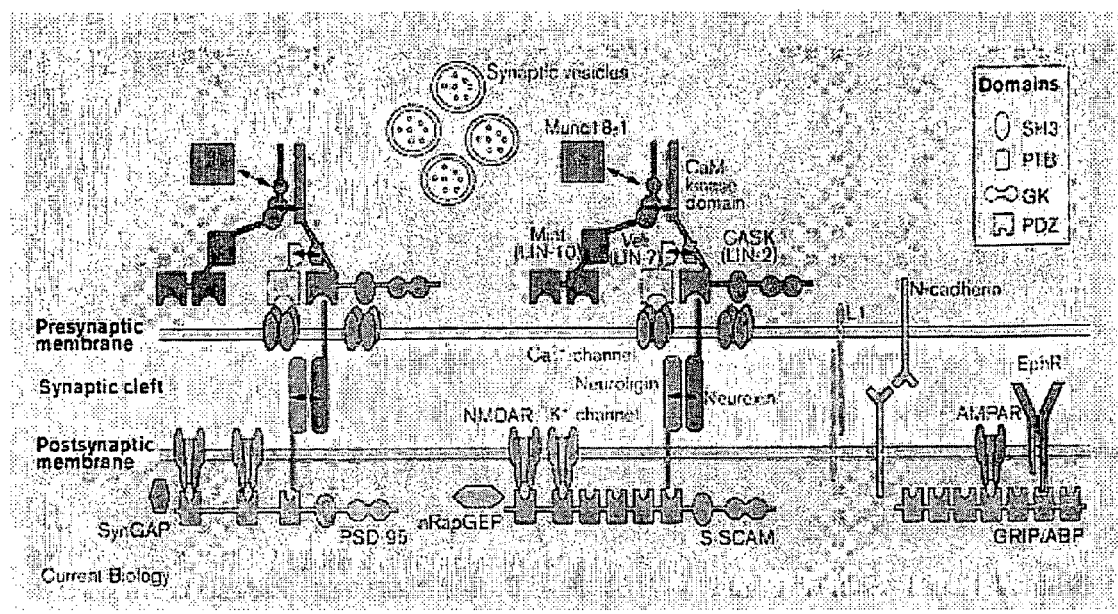
FIGURE 3
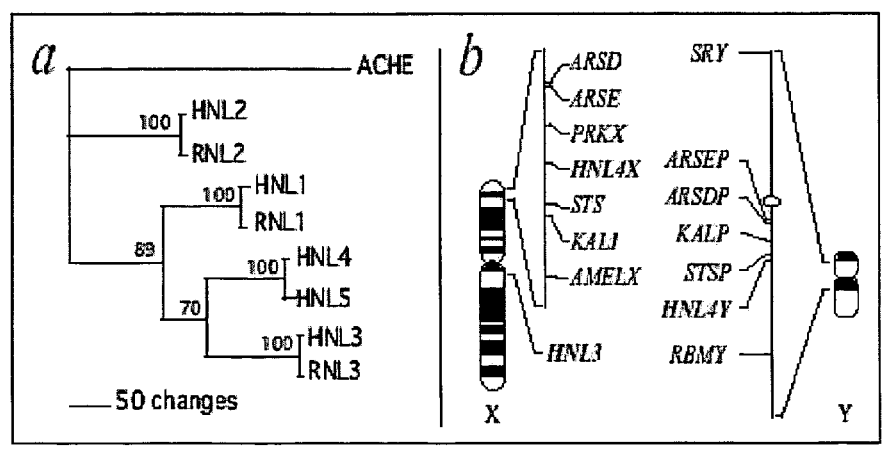
FIGURE 4A FIGURE 4B

FIGURE 6A  FIGURE 6B

> gène HNL4X (SEQ ID NO:1)

Contig joins AC019328 (118849-136028); AC079173 (165018-1); AC078956 (144914-173130) (99094-1) (218402-203634) (271472-281661)

>HNL4X Exon1b (10670-10828)
C/EBPalp (10561-10571)
Sp1 (10608-10618)

```
ttgttgccattacctttttttttttttttttttgtgagacggagtctcgctctatcacccaggctggag        70
tgcagtggtgtgatctcagctcactgcgacttctgccgccaggtttcaagtgatcctccagcctcagcct      140
tctgagtagctgggactacaggtgcgcaccacaacaccctgctaattttttgtattttttagtagagagcg     210
ggtctcaccatgttggcccggctgacatcgaactcctgaactcaagtcatccacctgccttggcctccca      280
aagtactagaattacaagcgtgagccactgtgcccagccctcagttacatttcaatatgagacaaacaaa      350
gaaaaaaccagcataattatatctcaaatattgcacaaaacattctttagtaatgtttttgtgagtcct      420
atattttagctgttaaatctggcaaccctaggcccagatgtctgtgctaacgtctggtctatctaccac      490
ttagatagatacttgtgtggttataagctgtatacttgtgtagttataagccgaccacaccacttctccc     560
agacagcttcctacataagtttcctatgacaaagccctgtcttaatactgctcatcttctcgaagacg       630
cattttaaaaaatccattaacaccttcatattaattagggcacttcctgtgcaagtaacataaacccat     700
ttaaataagcttaatcaaaagaaaacagaaaaggaaatgtgttcaaggatacaggatgtctcacaggttc    770
caagggcagtatagcaaaatgaacactgtccactaaaaattcatgtctacccagaacctggaatgtgac    840
cttatttggaaacaggggctttgcagatgtaattaaggtaaggatgaagatgagatcataccagattaag    910
gtgggtcctaaatctaatgagaatgtccttacaagagacagaaaaagacacatgaagacacatacagagg    980
agaaggccatagggagatggaggcagagactggagtgatgcggccacaagcccagggacgcctggagcca  1050
ccaggagctgggatagacaggaaggatactcccctaggtcccctggagggagaatggccatgcagacacc    1120
ttgatctcagacttttgatctctagaactaggggagagtaaatgtctttggtttaagctgctcagtttaa    1190
ggtactgtgttacaggaggcctaggaaattcatacaggtaagaatgtgatgggccgggtgtgagtagagt   1260
gcacctgtcatttcagcacttagggagactgagaagcaggaggatcctgtgaggtcaggagtttgggacc  1330
agcctgggcaatctagtgagacccgtctttatactagattggtgcaaaagtaattgcggttttttgccat   1400
taaaactaattgcaaaaaccacaccaacttaataaaaattacaaaaattagctgggcgtggaggcacaca  1470
cctgtagacccagctactgagggaggctgaggtagcaggatctcttgaggtctcaggaattcgaggctgcagt 1540
gagctatgataatgccactgcactctagcctgggcaacagagcaagactctgtctctaaaagaaaaacaa   1610
caagaacagcaaaagaatatgatgaagatgtagaaggatgtgcagccctttctcttgtcattcattacct   1680
ttctgtcttcatatctactttgtacattgtatataagcttcctccattttccactggacaagtgaaaa    1750
gcatgaccaggaaggcccctaaatttacctgttgcctgtccatcctctgacgtgccaccatttgctgtgtg  1820
tgtggctgtgtccatggactgcagtgtcacagttgtgagccagcttccagggactgcatacccatagcc    1890
cggctcagcttagatgctcaaccttggaccaagcaacgtggccacaagatgaaaatcccttgggtggat   1960
gctactttaactctcagcctggatgaccagataccataggaggccatgcaaagctgtcctccaggcaagag 2030
cttctccaactttggcgtttggtgcaaatcaccagagaacatgtcaaccatgtttgatacagttgat     2100
ctgggtgggggctcaaagttatgcattttaacaggcttccaggtattaataacacccatgatattaga    2170
ccgaggactataatttcttagcaaagtatcaaaactctagatctttgtatatttgcaggaaagac       2240
aaggtactgcatgggtccaggtgttctttacataattttagtcatgactcttccaggaaatattaccag   2310
gctcctaatacaccaatgcttaataacagatcaaaccccactcaaaacaatcccattggtatttatcat   2380
atgttgcatctgctctgtttccacatgtatgcatacacacatgtgtgtacttgtcacatgcaaaacggta    2450
tttgcaatacattccctgtcttctcaatgaataagacctggaaaaaaccaaaataagtgtttttaaaaa    2520
ttccaatacagaccctcgagtttgaaaagataaaagggaaccattgtcctagaattttttctgtcaacctca  2590
ttttatttcacctaaaattataaaccacactgcattcaccagaggtggtctatatgcctacatacctatg    2660
tctaacaccggtcattaacaagaaagaaagctgtttgcttgagctttaataaataaaacacattgatgct   2730
gcctcttattgtcttaccccatgtttaaatgtctcttttaaagtacaaaggaagaaacaggaagagag     2800
tccatgtgcacaccccacaagagatacaatcaggcataagtcaaccatcctgggaatataaaccctct    2870
gtattgtataagataatatagatataaatatagatatagataaatatgtatcaatatatagagataacta   2940
ttcatatagacagatccatatctctatagatatctatagaagatacagatacgcatatatatgtcataga   3010
tacctatagaagatacagatatctatagagatagagatacagatatacattgaaacagacatagcaattt    3080
ctataaacatctatatagagatataatttatgaattatataagcctatctatatgcctatttctaaatct   3150
ctctctatatacatgcatatcaataattccaaggtcccaaaccttggagaaagatttatgtatatttccat  3220
actttttaaaagtgtagtgcatgttgtcattcatcaaagcgacatagacattgtaaaagatttccatttta  3290
aaagtcttaggcaagaacagtggtacagtcgctgcagaatgtcatttaaaaatgaactctatttgggcc    3360
tcttatttggattcaatatccttggtttctcacaaaagcaatagttaatggattttctcaccgtcaatg   3430
aatgtagtgaaattttggagcctgaatctttttaaaaatcagggcgtttaaaagtcatttaggctcat     3500
catgcccagtgatgaaataataactggggatagaattcaaataatcaaatggaaggccagcaaagagca   3570
taactctctactgtggatgcatgttacataattaatggtgtgttacaggtttgaaataacagaagtcaga   3640
aggacaaggcttcaagaaaccagaaatagactcttgcccacaaagtatctcttattccatcatcaga     3710
tgcaaaatcgaattaaggggtatgtacaacctttttatcggaaatatcaatttaaagtatttccttcaa   3780
gctgtattaatctatataaaatactttccctacaaaaccaatgggaataaacaagagcatctctttatctc  3850
ctccatctggatttctgtaattatatttacatgtaagaaaatgctatatacattcaactatttcaataaaa 3920
tcttatttaagtgactgacattaattttaaatttatgataattcagcttcaactggtctggagtttactt   3990
gctatcattgaaagaaaaaggttgatttagcaactttggagtgtaaaataagacagaatgaattttgctt   4060
aaccttaagggtgcaaatatttctaaggtttacagcatattactcttatttaatctacgttgttaattac   4130
cttatattttaaaagactttaaatcctgtttgggaataacatttcttaaatgtttctaaaaactgagt    4200
atgttgtttaccctggtttatgatttatacacatatatattttagatattttctagcttacatatatat   4270
```

FIGURE 8A-1

```
ctatatgtaaatatctatagctatatcttttatatatctatatctatatatttccatgtgtgtatatag      4340
atagatataggtatcaaaacaagtattatataaatgttactcttgtcctatcatttctcaaatttatta      4410
aacctcatgttctgaactggcctcatataatggtgaccacctaaggcaattatcatcaacatgtttccga     4480
gatattttctaaaatggtgtctacaatagcaaatgaaagtaagaaacaccacaaataaactaacagatg      4550
aataaaaataaagtggaacaatcgttcggatcagaagggcattgggtaaagaattagctatgtgagggc     4620
aaagactatgtcttatttatccatcttgaatattttgcagagtttgtggaacaagcaacagttctcacat    4690
tcacgcttagtgaatagtgaataaaaatagcaatcagcaaaccacttaacaatgacccaccacaaccctg    4760
ctatttctgaatttaccttatcttttttttttcctttcacaggcagactataattatgatttcaacttcct   4830
catcggatccccagtcatgaatctatctaacatattcagctgaaggctgtcaaggatctactgattccac    4900
aatgcagtggtactctcccatcgccttcactcctaaaatctctgaagaccatgacacagttgactcctg     4970
cctactccttgtggaggttaaagtccttccttgaattccataccacactttctcttaccaaagatcttct    5040
gcagatgggagaatgaccctatttaggttgttatcaagaccctacccagtgtcacttctccaaagatt      5110
tgccttttctcttaagggaacactttctctatttacaccaaaatgttaagtatcatatccatagggttt     5180
gtgcttggatccgtagatcctaccttaagatccctattcaggtcaaatctcctgtcccaaagatctcagg    5250
tctgtgggtcattggtatttctatgatccaccagcacctcattttctttccacacaagtgactctggct    5320
gagtgcactctcattcatcttagccttcccatctccacacatgaaggctatctctagtatcttctcattt    5390
tagggctccatcccatttttgctcaacttctgcaactatgcatatagtcaaatgccactcatagtgaaat    5460
aaattcatcataactgtgttattttcactaatactgccctaatttatgaatgcagcagcctcgctgtact    5530
ctttttgttctagaatgtcccagcccttaaatcccctcagagtaagctctctgaaaggtaatctctgctac   5600
catccccgactaacacccataaggattccagccaatgaatattcatcaacctctgtagtccagcctgacc    5670
aatttcttcttattctcctctatgaatcataagaacctatcatcagctcaccaccactcctgttttcagg    5740
gtttaattgaggattatctaaaaaagcaacctcatgtagcagggtggcccccaaatgcaggttccaag     5810
aactcactcaagacctgctaggtttgaatcctggtgtttagctctagaggcatggattttgtaaccatct    5880
tcctgggtcatccttgtgcaccttgaacttccaaagcctttgctcacactatatctgtttctcgtctcca    5950
gatattgttaacttggaataatgtcccaccccctgctctccaattccccagggaaaccttgttcatctgtg   6020
aaccattttctcagcatcccaataggaagcctgttacgccttctgtatgctttggagatggcatatgtca   6090
cacattgagttgcattttaataattaaagagcttaatttatcctcttattagattttaagcaccttctat   6160
actatacatatttctctctctaataatgattagtaattaataacatagtatatattactattgcacgaac   6230
aattattatcctactgaaaatatttctgtttcacttggaccattgtattaggagagtcagtatgaatcag   6300
tagtgccccactggcttcaccagtattgcattcagagttctacgtattgatctcacaggagcttgaacat   6370
aataccagaatgtggttgatggagacactgagatggaaaatcagagagaacaagtagtgtggtatagatt   6440
atttctcatgttccctccagttcttgtaccaaactcagcttatatatctttcttggaaccctacagtttt   6510
atttcattttatgactccccccagctcccacatttcaccatactccacaattagatttaaaatggaagcat   6580
gaagaatgatactcttatctcttccaggaattgtggatctaaacctctgtagctcctctgtctgtgttgc   6650
aatctggtggcccagttgttaaaaattggtgttttgggtcctatcctggtctcctgtaagggattttgga    6720
ttagggaaaatgataatttcataacatcttatattcactttttcttacaatcatgattccacctgtctaa   6790
gatgctttctgactttttctttttttgagggagggtctcattctgcaacccaggctggagtacagtggc     6860
acgatcatggctcactgcagcctcgacctctctggctcaagtgacctttcccccttcagcctcctgcacta    6930
ccactcccagctagttttaatttttttatagaaacagggtctcactatgttgccctatttttcaaatta     7000
tttttaaaaaactcctcaatggagtcattcagatagaagtgaaaatgtgcttgcctgctctcttcccaggt   7070
cacatatctcagggaagagatctggtacccaaccaatccacccacaagctaagccaagcattcagatttt   7140
gcccaaactctccttcccaatcttacttatcatgctgccttatttagaagtgatgtctccccacatcaa     7210
cttctcttccctcactaccctccccttccttttccctccttttcctcctttttctctttctctctct       7280
gtgtctctcattcaggacttcatttgttgcatccattcttgcaacaatcttacaaatattttcttttctt   7350
tccacgttggccctcttcaacttgttctccatattgccatcacagtgattgtcctaaaatataaatctga   7420
tcatttcttcccctctccctgcagaaaatatgttactggctttcccactgcctactggataaattccacc    7490
ttttcagtatggcactcaaaattcttcacaattaggtctttaatccttttcccttaccaccttctttcata    7560
ctcaatgtcatggcattccaaaccctccccctatttctagatctccacacatacagtattgctatgatgtct   7630
ttatccatggcttcttttctcaacttcttgacccaatcagtgtctgtgtaccattcttccctactcagaa   7700
agttcttcctttgcaaacccttctttaatcattttcacctccatgggtccctatgaattcatatgtattc   7770
cttgtgcacaccttcttgtaatcatatttttctcatgcttttggctatcttgtccactagactgtatgc    7840
tttctcaaaaataaatggatgagtttcactcacagatgcatgtcagtgcttaggactgcaccagtgctaa     7910
aaaaaaaacaaccctgaatttatgaataagtcaatgaattaatacattcttggcaaaacccatgactttc    7980
tggcctactataaattactgtgttcaaggtgagattctgctttagtttaggatatagatatctatatata   8050
tgtccatatatctgcagctatatatccatatccatgtatatcactgatttggggaataagctatacttat   8120
taacaatattactatgttaatgggtcttcaatatctatacaataacggaaaaagtacatgcatatttcta    8190
aatatctatccaataattggaacacacacgtatgtatggatggatatattttttttttattattgggtata   8260
gatatctattaatagataagtgtatatttatgtacctatcttgttggtaaaaggtgcttttatacatatt    8330
atttcatttagtctccacaagaaatccacaggaaaggtaattttaatctcagtttaacagattcacagaa    8400
cataactgactttacaacaaggcaaagtttgtgaggatagagtcttaacatgaaaccaggtccccaaatt   8470
ggtgtctatcaccttccccattattggtcaggctgcccaaatatccttcacatcaccatggcaggcttca   8540
tgctttggtttactgcctaaagccgaagcaattaggaggatctctatgtgttgcggacactatcttttt    8610
ccttccataaatgaattaatgggccatgaaataattttaagaaaagctaactttttctggccaagcagaag   8680
aataaaagtaatcaccatgtaatattgttgtgaagactacctggcccccacacattaactcagctaatcat   8750
tacagtattacacggtgattatctgttccattttacagatacagaaatggaggcaaacgattaaaataca    8820
cacctaaggtcacatgcatcttgaacccaagcaatctcattttaaaatccgtgttcattgtcacaacact    8890
ctattatgccctctgatcttttgcattgccaatttaaatccaactttctccaactcaacttttaagtacagg   8960
ggtcatacccccgtcctcgccccccgcaacttgaaactccctgggaaagataacctcctggaccctggaa    9030
atgaagaggcgtatttaaaaacaaatgcctcatcctgggcacaattccaacattttatcaaaatcatgaa    9100
agtataagaatagaagtaaacaaaaagctttcatcgatccctctcaaccatacctgagcataaaacag     9170
gtcctgtactttacagaactgtattccaaattttgctgctcttaaaaatttttttatatcattgcttcc    9240
caaatgaattacaataacgcagacatagagactgctggagatcgtgacctaaacagttaagatgtttg     9310
catatactgcagcatgtttggtgtggagggtatctagagagtcctaaaaaagcaaagaggaagaaggttt    9380
```

FIGURE 8A-2

```
gctgtacgcgtctggtgcggtggcaccgtttgccatgcccacctgctctatctcccgagtacccgggatc    9450
tctccgttacagctggtttgcattgggattagcagctctttgcatgaggttgtagctgtggatgtggttt    9520
ctgtagtgatggggccgactccggagatctattggctgctggctttgtaaatttcattcagtttggtcca    9590
atggcagagggagagccccggagacagcaggacctctctcctcaatctctctttttcttgcagaaccgtc    9660
tctctccctttctctgtctcttagcacagagctcttattcagccactagcttggcccttcctgcttcaatt   9730
gtaatgcttgttctgcccgtccacagactattggcggcagaaacaacgaatttcctccaaactaggcggt    9800
gttggtggctcttgcattcctctggatgaggaaatctagttgggggtccagaaggggaaggctcctgg      9870
gctttcaatacatcctcctgaatcatacctcgtttcgggttccctagaaaaatctggacgtgtaaaaga     9940
actcttaacgccgatgcagctcttccaaagctaaggtaggtgcagtttttaagacctgtctctgggacat    10010
tattctcattttaaaaagccgtttaaacattttgacttgcagcaaaggatggaaagcctcactgcagata    10080
cttgagcttcacttcatctgatctttattttttccttttatgattattaatattattttttggaaaatttg   10150
gacaggacttctctcccatctgtctcgctgcatttcttaggtgtgggtgggagtgtagaccttcatacggt   10220
ttttacatgcaacctctccacagaaatatttggttttattttcacttaaagagaaaaatccagaccaccg    10290
ttgtttggaagcgttttgctgcaatcagctatttgaacggctctggggccgtgtgtgatgtgtttacaaa    10360
gtagcgctgccttccacacaaataaacagaagactgtggcggggagggaggaaaaaaaatatatatgtat    10430
ctgcagtacagggagaagaaggagagaagcggccagggctgagatggtgaaggcaggaagacttctgca    10500
aactgtgaggcatgggaggcttttcttttcttttctctccccccccacccccccccttattctttaag      10570
aaaactgtcagctaccaccgcctggggtgcttttttgaggggttgggggggtgctgttaaccagaaagaa    10640
aaagggaaaaccggcttggttggggtcgcatttaagcgattttttttccctccttcatctccgggcctcg    10710
gataagatgacggcttgggtgatgcacgaaataacgcacgtgattgattagacctggcttggcttggcta    10780
gggaacgatccaggcgcgctggagaccccgcgtgaagatgaaatgacggtagctccggctgcttctgta    10850
aaccggggagcggctccatgcacccctttcccgtgtgtgtgggtttcgaggcgggtgggaagggtgagc    10920
aagccgcagaaggagggtagagctggtggttttgcttctttcggagcctttgagtgtagtctgaaccttt   10990
gagggggcgcggggggcttgcactgccgccctcccccatcctctgaactgcccgcttttccgaagga     11060
gcggaaaagttggaagctgcgaggacagactaccggagccctggtctgggtctcgggggatctggagccc    11130
tagtcggtgccactgagaacacccctttctcggagcgagggtctcgggggagtgttaagcctgcggggc    11200
gcacggtccgccagtccccgaggtggggacggggaggaggctgaggagtcggttccaataggcgcacca    11270
cctctacagccctggaaaacgcaaccgccacccctcttccctctccatcccatcccaagctctctgctg    11340
tcccggggcgatttcatctcgtctcttcccccgcctccccgcttcccgcctcccaattcccgcgcggct    11410
cggctcagccccttcccactccagtgggcagaactgatggagaagatccgccaagcgcgcagccggcggc    11480
ggaggagacagtgcgggtgggcgaggggcttcgagaccacgcagagagagagtgaacttcagtcctgac    11550
ccctccccaaggccgcggctggggcgcccacagcccgcgctggcacccgcgtggcctgacctgcggaagc    11620
gcgagcggggatgaggtagggagagggaggtaggtgccgctcggctgcagatgatgcgtgggtgggggc    11690
ttgctgtgggaggagaggcccaggtccggcctgcgccctccaccccgcggctgctccctccgcctctgg    11760
ttttccaagaggccggtcgctaccccggaggacactctcatcctcagtcagtctcctggacaccccttc    11830
ctcctcctgtccctcaacctgacctggctctttcgccccctccgagaaccggtaggctggggtccctcggc    11900
ggggttctcctgggccgcacccgaagctttgcgccccggtatccgggcccagtgctccgtgcaaccctg    11970
ggcccgagcgcacgattccggcgcctgctcgccgcagacacagcgcccttcttcccggagcggcgggg    12040
gcgggagcaggggggtcaggccaaccccttgcaccccccgaggcctgggcccgggccaccctgggaacggat   12110
gttctgcatggagagcgaggggcagccggaggacgtcctccgcatcataccctcccccttcccccagaagg   12180
cttttttttttttccggactgcgggtttcttttttctgccttcttcctctgaacctacggcaggtgtcag    12250
cctcttttttgtgtatgtgctgctgctatctcggggatggcggggagggggtgcaggaggcagcgtgaag    12320
gggtcctaggaggttccggcgggggttttggccgtgcgcggggcttgcaactgcccgggtgct            12390
gggcgcgcgcgtcacgaattcagcctagggcttgggcgagtctgcggggagtgaggacagaggatcccga    12460
tctgtcatttggacccaacttaagaaatttggggtgggggttgggtgggggttttggaactaagcaggtg    12530
atgttcttgcgagctggatccacaaggtggtagtatggcttcttttatttttattttattttattttcta    12600
tttggtcatttttttggggggggcggtggtttgttgttgttgttgttgctcttatcttatgcttttga      12670
aggcatccgttgcccgtagggtttacatcggagcgcgtttgcattatattttcttgaaaggggggtggtg    12740
cgtgagctcccatctcagaatcagcccttccggtgatgtgaggaaggcaaaagcaaaaaaaaaaaaaaaa    12810
aaaaaaaaaaaaaagaaaaaaagaaagaaaaaaaggaaagaaaaagtttagggagacctcgttatc        12880
ctgacgaagcagaattgccagtttgtgtgggcgttctgcgggcaacatagaagtgcatgcttaagaaatc    12950
cggggtagcttccttctccagctagaaattaaatggccaggtgcaaacacctgactttgatgagaacaa    13020
agcggcagaaactgcaagagacctgcatggtttgaatggacgacctgagcctttcctagggatggcag     13090
agcggggtgaaatcagatagcaaagaaatctgccgttttgtgggggcagatttggagagtggagaattat    13160
ttcataccttagttggctgtggggaagatgttagcagtaatccattaaatcctcagcatagattttcct    13230
gtggaaatgagcaaaatgttaagtgggggagggatggctaatggcacatggttgcattaatccctgtatt   13300
tccagaaaaaaatatggaatttctgtgtatcctaaaattaagaatacaggaatttcatggagaactctgc    13370
aagcatgtattttctcagattagaaattcagtattttattactcaatgaaatgtagaatgcgtgtgtgtg    13440
tatgtgtgtatacagacatacacacacgcattctacatttctacatatatgtgtgtgtgtgtatatat      13510
atatatatatatatatatatatatgtatggccatttttaaagagtattttctttgacatgtaagaacataa   13580
tcagggccagttgtagcaagtggaaaattacttcatcagttttaagtcagtagattaaaatggaaggctt    13650
catttttttttgaaatcagaataataattgcattttcataataatgcctgtgcgtggatgcagtttaaa    13720
gatgctttgatgttttcttctccagtggaagaattgctacttttctttgcgttttattttaaataaactaa   13790
tgccgagtatacagttggcccctcaaaccagtaacctagctgattttttacccaaacctgagaatgtaacag   13860
atacttgataagggactggtggctgcataaggtagataatgaagttatcttgatgctgtgaaatttacaa    13930
gcagacttgaaagaatttgaaagttcatagttgttggcctgaatgtagcctaatggtaaatatatagat    14000
ttttaaaatttgtgaacttggctatttcattgttttgtgtgtagtaattttgtggaaagcttatagtctc    14070
tccacaaagatgagagtgttgactgactccgcaacagagacttgcttttggaagtgcaggggtctcttta   14140
aaagccatttggaatactgtgcttttatttctagaccacaaccaaaaggttctcaaaaaactaaacattc   14210
aagtgcacgagggaatgacctccgttaacattcttttcttttaattggtacgccacatttcaaaccttt    14280
tgtaatactgttgaatattgccaataatgcaacttgttgagcgaatgattgcattcaaatgaagtagcaa   14350
tatacaaatattttaagtcctttagtatcctccttctaaagataggcttatctggttaaaatatacttat   14420
attccaaataaggtgagagttggtcttaagatgtgaatgtcaagtgtaagagacacgattttagttttgta  14490
```

FIGURE 8A-3

```
aaccagaatgtattctttctgtactgctttctgccttttaacaatatgtattctattcccaaatggggaa       14560
atatgttcagtttagtttaaatctgttgctctttttgtgtgtgttttttgtctgagtactgtactttttca     14630
gaggagagacttcgtctcctatttaattatgtgaatggatattcagacagatttgaatagccaccactga      14700
tttcttaaactcctgagctaccagttttaaatcaaagatacatcttttgcacagtcaattagaggaagtg     14770
agaatcaaaattgaagcccaggctgctgaggcaattaggtcatctgctgtgctctctactaccattcact     14840
caacgaatattttccagttctgtcatttttctctaaacaacctacatttggactttgaaaggctccactg    14910
ttctttgttaagtgaacggcagtgtaggaagcccttcctcatttttcttggagcacagtagcacacatga    14980
acaagaaaaaaagaaggtgatagctcctagcagtttgtcattgtgccattatataggctttgaataaatg     15050
tatagatgaaaaggcttccctctgcaggtggttacattaaacaaaaaataagtaaataaaagcctcata      15120
aaatcattacgggagtggaaggttggtggtggaaaacagcccatctacctcgggctgagatttcaaactt     15190
tagacatctcgtgttcagttcacgtgtcccaggtgtgtgcggaacacctccatacaccatcttcccaa      15260
ggcactctcatcttcccagaaatggtacctgaaggagaacagacctaaccccaacaatactaaaatacgt    15330
atataaaaactatatatagtaagatatgtatcctactataatatatatatggtaatacatattatag       15400
taaggtctgcatcatgtatataaaaatacactatatatcttattattatatatatagtgagatgaggtgt    15470
attaatccattctcaggctgctaaaaaagacatacccaagactgggtaatttgtaaaggaaagaggttta    15540
aatgactcacagttcagcatggctggagaggcctcaggaaacttacaatcatggtggaagggggaagcaaa   15610
tacttccttcttcacatgatggcaggaaggagaggaatgagaaccgagtgaaggggggaaacccccttataa  15680
aatcaacagatcttgtgagaacttactcactatcataagaatagcatggggcaaactgccccccatgattc   15750
aattacttcccaccacatccctccacgacacgtggggattatgggagctacaatccaagatgaggtttgg    15820
tggggacaaagccaaaccatatcatgaggttttattgaatttatttgagacaggaaaagagtaatcctcc    15890
ataatttagaaaggagatgaagtacaatgaacatttaggtcctcattagttgaggaatacatttcaaaga    15960
gagaaatgttaatttcagtatagtgctaatgaaacgatctaggctttcactgctctctggaaatgtggat    16030
aaatggcccagaattttgtttgggttgttttatttaaaatgtatattatataaagaaatcatggtttgtc    16100
aaagtaacagagtgctatttttgccttacaacaggactttcttagctccacctgttaatatcggtgatca    16170
ttttggttttaagaggctggtacctgattggatgatgaaaacttggatctcaaagccatcaccccagaca    16240
tgtgattttattaacatctgtgggcatctgtccggctcccacatcaaccctcatccaggctcatttct      16310
gtttgttttgtttggttgtttgtatgcttttggttggggagagggggacacggattttgctaagggcacct    16380
ttttcaggagtgaaacttagcctgtcatataagctgaaaaggaacttgggttgttcaagttgcattact     16450
tggtaagttttttggatccttaaaaaagaaaggactgacgttactaaaagtgttattggcactgataaaa    16520
gagctatggtgaattgtggtttgttttttgtaaagtgcagaaaaggcctcttggttctgtgatgatggct    16590
gtggtgaagttgcatgcggtgccattttccatgtttagtatttcaacaccaccaatatgtggctctggag   16660
tatgggacgggcaagtccaagaactcagtgaggcatgccgtgtgactccaatggtcagagctgttcagca    16730
tggaactgtggtctcaaaagcatgggggatggggggcagaagaagctcgctgcaactgagtgccttttaact   16800
tattccactcttcagtactctctgtgactataactctgtgaatgggttaggtggggaaactcacaaaagt    16870
aaatgcatgttttcacaaacaaaatatgtcattgttaactgttttcctaagtgagacaatatgccctcat    16940
gccctgaagctacatggtaagaatggcagtgtgtatgagcggtgtatacacatacatgtatgcatatgc     17010
taacacattaactaggaactagtctttgctgaaaatgttttttctcagccattgcaacacattagataaaa   17080
gcaaatatatatatatatatatatatatatatatatatataatataagaaggaaaatgtggttttcca     17150
ttattttcttttttctaatcctcatcattca                                            17180
```

>HNL4 Exon2 (66564-67333)

```
attctcagagggtaattatatagttcgatttaacttcttcaacagaccgactactacagttgatgagca       70
aggagatgaaagtatttgataaacatcatgaagttaatatgtcttgagggaggggagaaggctgcttg        140
tcttaggtaatgcttttgagggtaggtttgtcctagcctgaggtagcaggcttgctctgttggctgaag      210
aagccttaacatgcatgcccgtattgcaaatttacccacatgccaactgtatgctgtgggaagaaatgaa     280
taatgtagatgccattacagggaattaggcggaacggatagacttagtgcatcagaaccaatgagaagta    350
gacaagacatttagaaaatagcaacagcaatgaaaacaaatataagtaaaccacaatcaaaaccccttaca   420
tttgggtttctagtttgcctgttaccacagagggttctggttactgctaaaatgtaacccagtaggaagg    490
tcaagacaaggcccctccatgctgtctcaaacagtaacaaacagtaaggatgacccagggagaaagggtaa   560
caagttacatggaagttaaataccagttacctgtgcagagactgaaaacataaagcagacacaggaatgg    630
cagtagtagaaagtggggaaaatctgaatttgttgcagcataaaaccaaccaaccaacctagtgaggga     700
atcaatacctcaaaaaaaaatcttctgacaatctaggttcatggtagagattaaacggtaccatattat    770
gaggacagaacaataaatcacacatggcttcccatagaattgtgtgacagtggttgtgtactatgattc    840
agtctgtcatgacaatttcaccagtaaaataaccttccaggatttatttgatatctcaattgataagcct   910
cccgtaagtgaataaccagaatatgacataatttataaaaattaacttaaaattacacaagaagttatgt    980
gtctagtcatttcacaatcaaatgtatttaggcatttaatctagtaagatcccaaataataaaaaattgt   1050
ttcttctagaccaacatgtatcctgatgttataaatacatatgtaaattatatacatatattgtatat     1120
gtaaaatacacatacatttacatatgcatacatagctcactttttattgggagcacatcttcctgaagg    1190
tttttcaaagaataattattctacctgtaatgctgtagcagtatttgtaaaaagttcaaatgtggctggg    1260
tacagtggctcatgcctgtaattccagcattttgagaggccaaggaaggaggggttacttgagcccaggac   1330
tttgagaccagtctagggaaacaccatccatacgaaaaaatttaaaaataagtcaggtgtggtggtgcat    1400
gtctgtagtccctgttactcaggaggctgaggtgtaaggtcacttgaggagtatatcaggagtttgagg    1470
ctgcagtgagctatgacctcactactgcattgcagcctcacttttactcaggtacctgggggcattctgga  1540
gaattcaaatgcctcatttatctggacagaatttgattggtgttattctattgctgaataattccagggt   1610
atgcatttaccttttctctattgacttaaacatagcttatgaaaaacaaacaaacaaaaccaaacaga     1680
ggagtttgcaaaactatatttaaaagtaaaccatactccctcaccctgactccaaaaatactgttta      1750
atgtagagaaaccacagacggtgcagccccccaaatctggagcatcctcaggtacctggggggcattctgga  1820
gtgaggggctgagcctgaggcattggtcacacttgggtgggggatgcctcattggctagtgaagaagc      1890
agctgtctcttccatgtagttggtcagttgtggcctctcctggaagggaatttattccagcagtgtgtgttc  1960
ctgaagatgctaatagcaaattatgttcagtgaagcagctgcatcctgttggtcttgctagtcccggga    2030
ttcttgccacagcaggtcagaatggaagggagctgcttatctttcctcctacttcctctcccatccca      2100
```

FIGURE 8A-4

```
gctctcatctgacatccttccaacacctatatgacaggaaaaaaattctctcttcaaattaagaaaaggg      2170
tctggtctgggtacgatggctcatgcctgtaatcccagcactttgggaggacgaggtgggtggatcatat      2240
gaggtcaggagttcaagtagtgaaacccatctctactaaaaatacaaaaattagccaggtgtggtggca      2310
cgtgcctgtagtcccagctactcaggaggctgaggcaggagaatggcttgaactcaggagtcggaggttg      2380
cagtaagctgatatcacgccactgcactccagcctgggcgacagagcaagactctctctcaaaaaaaaaa      2450
aaaaaagtgtttgagtatttactctccacatctttcagctatttcacttcactgggagtagacaggacag      2520
gatggctccagggacagtgctattgttaccttgttatccacttccaatttggaaaggtaaaaatatgctt      2590
cagtgtctactaaattgcctgcattgaatttgaagtacagtttgttgggatactcatgatgaaattggaa      2660
aacagaatcacagattgttaggacttgaatgtacttgagcaatcatttgtattccctcatgtacacaagg      2730
aaattgagtcacagagagtttcagtgatttatcctcatcctttttttttttttttgagacggagtttcgc      2800
tttcgttacccacgctggagtgcaatggcgcagtctcggctcaccgcaacctctgcctcccaggttcaag      2870
tgtttctcctgcctcagtctcccaagtagctgggattacaggcacacaccaccactgctggctaattttg      2940
tattttttagtagagacaggggtttctccatgttggtcagctggtctcgaactcccgaccctcaggtgatcca     3010
cctgccttggcctctcaaagtgctgggattacaggcgtgagccaccatgcccggccgtgatttatctcca      3080
taattttaaacactatccctgcaatgaaaaaggaataccccccaatttttaacatatctgcttacgccagt     3150
tcatgacaagcttacaaaattagaagtaattttaaatgggcaaaataaagcaaagtgcattatttaattt      3220
tcaaaacagacttttctttattatgcagcagcgatttaaacagataaatcatttctatgaaagggactag      3290
cagagaaagcaggaaaagacatgtcccacattaaaagctgaacttgttggtgggaactcattttgttta      3360
tgagttatgatgaatgcaccttagctgtttctaaccccgctcccattccctgtttttatttgtaagtcag      3430
aacccagcattttttacattttttgaagtgttaattaattgcctttgtttaatgcaccttgctgtgtctca      3500
agcattgttaagaaaggataagatcttttttcagggatgattctttcctttccttacagggctttgtctgt      3570
gatgagaactttctatacacatattttttcttttaagagacggggtctcactatgttgcgcaggctggtc      3640
tcgaacgcctgggctcaagggatcctttcggactgacctcctgaaatactgggattactggtgcgagccac     3710
cgcacttggctctatctttctgcaaaaactggtggattctacttctctctccatctatgtttagtcctgg      3780
gagatataatcaagagaaaagaaacatctaccttcattagattaagagtcaaacaaaagggcctagaggc      3850
aaagaggctccacgaccctcttttgcgggtgagcctgtgcattgaaatcctcagcttcaaagagacacag      3920
aaggcaaaataggaagttggatttgcaggagttagtctcttggagggtcttgtaaaattgaagggttcac      3990
atatgccctgtcaactctccaagagagagatgacttggtgaaatctgtattttgtgatgattagtctttc      4060
tcagagggctggttcaagggcaaacgaagggcagaataaggacttgcagatgtgttaagaacagaacccg      4130
ctgtgttgtgcgtcaacgacaaaagcccactccactcctgacattcatatttgggggtaactgtttttg      4200
cagtgcagacctgtgaaacctggagtattttcagtcacagcttttatcgagatgctttctgttgacctga      4270
gaattaattatggtttgtcaaacagcttgacgaccttgtcagtggtgtttttttggttttttacaactcccc     4340
atctaaggatttgagaatgccgcagtggataaaactgtgtgacttgacgttcattattttttttccacaatg     4410
cttaaagtaagtgcgctgggaatgctccatttattatgtagaggagagacatttccaaacttttaacttt      4480
gttgctgttgcttttgtacactgaggcattgattctgcaggattaaaagaaggtgctgattattccattt      4550
ggtggaaagtttcaggagtggaagccagcagaattgttccactgagatgataattctgactctttgattc      4620
ttacacattgactactttaacaaaatacaaacctgttttaatctttttaaaggacatttgtgcgctactg      4690
ttttcattttttaaaataacctttttaaaaattttaggatagtttcaggttttgctgaaaggttgcaaagat      4760
agtacagagagttactctttaactccacacgcatatcgcatcttacgtggaccatctgttacacttaagga      4830
accaacattagtacgttactaagaactgacatcacaatttgtttggatttcactggtgtccacctaatgt      4900
cctttttctcttctgaggtaccatctgaaataccacactgcatggatttgccctatttcttagcctcat      4970
ctagtctgtgacagtttctcagttttttccttgttttttcatgacttaatagtttgaggtattaatgtca      5040
tggagaatgtccaccaactagagccagtctgatgtttttagacaggggtatgtgtttggggggaggaaatcc      5110
acagagatgaaggtttccttcatctcaccctagcaacggtgactactgtccagaagacttttgctgctgg      5180
tgttggctttgatcacctggctgacagagagtttgtcactttttctctgctgtaaagttgtactctcccct      5250
ccctgcccaagtctagtctttgaaaccaagtccctaaagtggggtgggggtgggagaagaggcagaatta      5320
agctccacttttccggatggtggaatatcgataaatttatttggaattcttctcaagaaagatgggtctct      5390
cccctttatttactttaatcaatcatttatatcagtatggacacatggatattttagatatgctttgggct      5460
acattgctgtgacttattccactttatattccttgtggccatgatgtagacaccagagagtctattcact      5530
tgaatagcaagtaaatgaggggactcaatggtaaatgactcttagagaaactctcagccctgctggttca      5600
tggatgctcagcttgcaaaaacaccttcttccatcaggaaacctcagtggatgggcaaacattacagcgt      5670
cctttgaatatgcttcattgcttttaatctacgaacttcctatgcagtaagcaaaaccacccatcaccagc     5740
ttaagagtggggctttcctcccaacactcatcctagtgtcttttgataaagaggtataaagttgaaggaa      5810
catgttactaaccagaagacttccagaggaccccattgatcagggtagatgaatggctgtgtgcgtcttg      5880
tcacaaccatcagtatttcaaaaggtgatatcatcctcttaacccttatgatgtgttttaacataaaattt      5950
taatatgcatacaggcggttattacttaagcattgcttaagaagcagtcttttttttttaattcatgtaa      6020
ctggatctattctctgaataaggaatataagcaaatcgtagccatttcaaggactctttttttttttttt      6090
taaatggagtcttgctctgtcgcccaggctggagtgcagtggcgcgacccttggctcactgcaacctccac      6160
ctcctggttcaagccattctcctgtctcagcctcccaagtagctgggattacaggtgcccacgagcacac      6230
caggctgattttttgtgtttttagtagagatggtgtttcaccatgttagccaggctggtctcgaactcctg      6300
acctcagatgagccgcccacctcaacctcctgacgtgctgggattacagacatgagccactgtgcccagc      6370
ctcaaggaggcttttaagggcaggatgttttttttttcttatgtgaaggaatgaagagtagtatgggaaa      6440
gaaatacagaaactttgaaaaaagaaatgtaaaactggatcatcattccataggctagtagttaatagta      6510
aataactgtatagtttgttcaagggattttgtgaatattttaaacacagatgataattctctatctacat      6580
ctacgtgtttacctgcatttatatcatatgtacgtatggacatatatatttgcctgtagatcacatctttt     6650
gtatggtatctgtaccaatattagagtctatagctacagcatatcaataacagtatctattcttatctat      6720
atctaatcatatctattttttgtatctgtacattatctttaccgatattcacattatatttctatgtct      6790
agatctatatatatctctatctataccattttgaactttacatttcctacagtatgatagcataagctat      6860
tttaggattattaaaaatcttcataagcattgttttttcatggttaattttctcaaaagactatgctttaa      6930
catacccagttctttatatattttttgacatttggcttattttaatgttttttgctcctctaatgtatttt     7000
tcttttttttactccacaccctcccgcctctaattttcaaattgggcattcttcattatagggcattgc      7070
ttatttttcttttgtatgtttcaaaaaacattctgcattggtctgtacacattttttcccctcttgtatccct    7140
tctgtaaacatttgtattcacttgaaaccttatgaatatttactacagaaaattctggttatgataa      7210
```

```
aaaaaggcagagaagatagaataaaggatcccatgtgcccatcagttggcttcagcaattatgaatggat        7280
agcctaatctttagtatctaacttcattcatatttccattcttattatggcatgatgtaattcatttaaa        7350
gatatgtctgtacgttgctctaaaatataggaaccattttattttacacagctgcagaatcttttccatg        7420
cctaaaattatcaacagtagttcctctgtatcatccactataaagttgtaactgtcaaaatgatcttctc        7490
gtagttttgtaactcacgcaaggtcaaggtctagcactgcaataggttgatttgtcttttacatttcttt        7560
taattgatatagcttccctatctttttatgcacattcttgttgaaaaaactgctcttttttactctacatg        7630
aaagtgggttttagaattggaaaatgtagttgtcaagttattttagaaggaacgtgtgtattttccgtaa        7700
tgcacagtcttaagttactaactccttaggagcaaacgctgtgtgacttggtagtgttctacccagaagg        7770
aatgctgctgggtaaatttggccagctacgtgacagctctttggactcagtatatctcagttttatctat        7840
ttttaacaaggtttattttgaagacagggtctcgctctgtcgcccatgctggagtgcagtgatgcaatc        7910
atagctcgatgcggtcttgaacttctgggctcaagcaatcttcccacctcagcctcatattatctagtac        7980
ctggcagagatacagatctgatgagaagcaaagatagaggggtgtcagaaggtagcttttgttgcaccat        8050
tacatacatacacacacacacacacacacacacacacacacacaaacgggcgcacacgcacgcacaaagaat        8120
caactgcaatttttttcctctttgccaacccacagttaagtaaaattattagttctattgaactccacatt        8190
gcatgtgatattttgaatgatagaggctaaagagaggccaaagagggaggattgcttgaggccaggagtt        8260
caagacgagcttcgacaacataatgagaccgcgtttctacagaaaaaaagaaaaaaaatagccagatgtg        8330
atggctcgctcctgtaatcccagctactggagaggctgagacaggaggatggctgagccgaggagttgg        8400
aggctgcagtgaactctgatagtgccactgcactccagcctgggtgacagagagattctgtctctaaaaa        8470
acaggaaaaatatgactaaagaaaaccaaactaatctaatctatacagttatagatagttggctatcatt        8540
cttatgctaatgtaagtatgcctcattttaagaagagttgtgtgtgtgtatgtgtgtgtatctgtgagtg        8610
tgtgtgtatgcatgatatataatccagacttctaagcgagtatcagggatggtgaactattattagtagat        8680
cattggaacctgttacacaaggatgcactagagaattttacaaactattaaattctgtataatttaaaat        8750
gtgacttgatttactcagatatttaaaaggatgcatgtctcttacaaaacaagatttactaactttggt        8820
gctcttgacgttgaggctggataattcttttgttgtggtggctgtcctgtgccttgcgtgatgctgaatgg        8890
tattgctggactcaagcttctaggtgcccgttgtatacacgttcctgtttttaaaaaaaaacttatataaat        8960
ttaacgggcacaagtgctgttttgttacatggatatattgcatagtgatgaaatctgggtttttagtgta        9030
accaccaccccaaataacatacattgtatccattaagtaaattctcattcctcatcctcatcctaccaccctcc        9100
caccttttttgattctccagggtctattattccactctctgtgtccatgtgtacacattatttagctccca        9170
cttaggagtgaggacatgtggttttttgactttctgtttccgagttgtttcacttaaggtaatggcctcca        9240
gttccatccatgctcctgcaaaagagatagtttcgttcttttttatggctgaataatatttcgttattcat        9310
atataccacattttctttattcatttatccattgatggatgcctagctggattccatatctttgctattg        9380
tgaatagtgcggtattaaacgtatgcgtgcaggtatccttttgacatagcgatttcttttttatttgcgta        9450
gatacccagtgtggggttgctagataagatggtagttctattttagttctttgaggactctccatact        9520
gttttccatagaacttatactaatttacattcccatcaacagtgtatgtggattcccttctctctgcatc        9590
ctcatcaacctctgttatgttttgagtttgacatccacaatgtctgcagacagtctcagatatcccttg        9660
ggagtaaaatccatcccagttaaaaagctctgttatgaaatgaggtgtacttattccaagttttacatgg        9730
ggaatttcactggttttttgggttctagtagcccccgacgtgtatactgggcatgaccagataagataaact        9800
gggcaaagagtgcaatgagatagtaaccacattatttggaagatgtttttcataaccagaatagact        9870
ttatgaattctatcaattgtaatgagaatcggattgacatttggggacagttaatataacgcacgttatc        9940
cgaaaggaggtggcattgatttatataagtgagagcttacgagaaaacaaagactggaaataagaaaaa        10010
gaaaatccttgataagtatctgatagaacaaagtgcagaacgaaatgcagctagcttatctaaaattggg        10080
caaaatcatgttccaaatgaaagctcagtagatgggagagagatatttgaacatttgatgtgaaaaatga        10150
gatttactgttccacagatatgaacacattgatgagagctgtcagttattagaacttattaacatcaatg        10220
ggaacaccagaaatgtgctgcacagaaaattaaatttaagactgtttgaaaatggtgttatatttctga        10290
actgttacattgattgattaaaattagattatccaacaaaataagaacttttgatattctgtgagtgaat        10360
atgagatgaatttatgtggcagatgtgttttaaaagatgtattattaaccgcagagattcagaattaat        10430
gtcgccaaccccaaagaatgcagtataacatttgtcataagtgacctcataataggtcattttataatat        10500
cgttttttaatttttgataataaatggacacctttttacatcttttaataataaaaggatatatgcaaaaccag        10570
ttatttttattccaatgttaataaaatagcaataagcctcatttcatttgaagcaccaactttcactcca        10640
tatcaaatttctaaaagtctgggagatactccaccaactagtcaagaagattttcattctataaaattgta        10710
taatgcagtgaatcctgttcttttcccatatgcatttatttaatatttatatttgatacaaggaatctat        10780
attatttcattaagccactcattaaacgtaagtgttttacttcttcctttgggtacatttttaaaaatttgg        10850
ttacatttttgagatgttgatgccatggttaaaatattccaactaagtaatgggatgggtttacaataag        10920
tttttgctctacaaggaaataggtcaataaatcaggctccagccaattataggagaaaaggaaagttaa        10990
cttattatacattattgcacacagtgtttgatgtatgtatgcaaattgctcccaaatacagtttggttgc        11060
agttgtgctccacatttatggtggatgcagttttgaatatgtgcagagagaatatattctgacctcattc        11130
atcaatgtgatgcaaatgtgtagaaatgtgcaaagtcattttttgatgatgataaaatgcctgtttggaaag        11200
taaactcatcctcacccatccatccaaaggttgcattttctcaattcccaattctaaatatgtctgtgtgtg        11270
tgtgtgtgtatgtgtgtgtgagagagagagagagagagaatctagtgcaattttattgttctactttgttcc        11340
aggcttgacattttagtgattgaaactaaaataccttgattcttaccctctaattttacaaataaaatct        11410
ggtttactgttatggattgaactgtgttacagattgaattgtgttcccaaaaagatatattgaaatcct        11480
aatgcccagcacctcagaatgtgatcttatttttgaaataaggtcttttgcagatgtaattacaatgagtg        11550
attaaggtggcccttattccgtacaactggtgtctgtaaccaccatgtgaagacacagacactcacaggg        11620
gaagacggccatctgatgatggaagcttggcatgatgcagctacaaaaagggaatgccaaggattactgg        11690
caactccctgaatttagaagagacaggaaagtatcctcaccaagaaccctcagagggagcatgccaaca        11760
tcatgatttggacttctagacttcagaactttgagagtatattcctgtttcctgagacataagccttt        11830
gtgattcttttgatagtaactctaggaaactcatcaccaagacacagagttattttaaattcatt        11900
tttttcatttaaaaatacttattgacaaagactgtaatatggaaagtgtccagtgtgatgactggatg        11970
tacgtatacattgtgtaacaatgatcacaatcaaattaatgaacatatcactcatagcccatgtggtaca        12040
taatggatggacctgaagttatgcagccagctggggcagagctgggtttgaaggcagactcctcaccc        12110
agccacacttgtcttccagaatcactttcacatcgtcatgaggattttagagactccactgctccatgtc        12180
actgcatcaacacattgtggagtgggggtctcataattcattgcaggtgtctgaagatcaacagttggg        12250
tttcccttccctcaactgtaaaatgagtgagttggacctgtctccagggccttttctaagctatatgattt        12320
```

```
gagaacaatgatcattgtaattaagacgcttgacttgaatactgctcatttttaaaccatgattagggata      12390
tgagatgctocgtgtgttttctaaataaacttcattgtgacctggttaagtgttggatatgaattggcaa      12460
gaggaggcttgctagtagaaatggtgtaatttaaaacccattcacaagtatttacacactgcaagacatc      12530
tagatcctcagaagtcaggtagtatcctaaaagcacagtgtgtaatttatggtagataattgaaattgca      12600
ctgaaattgaacttggtggtggggagtacacttcatagtattcaattttgccttcactttattctatgt      12670
ctgactctcaggaaataggaactgcaacgttgggtttctccagtgtattttcaacttcaaacttgtgaat      12740
tgtaaaccattaaacaaatgatcaaacactacatctttccctgctcttgtatggacatagagttttgtta      12810
ttcatgccttctcttttcttatctgggaagagatctttcttaacctttagaaaattggattaatgcgaccc      12880
tcttttaacctcacatttgatgtgaatgtcagaacttttgaaacttagctgtgcttttagtacactgatc      12950
actgagtgcccgttgactggcaggcactgggctgctcagtgaggtaggtgaagaagagacaccagctccc      13020
tcctgagtgtgtgctctgctggaggataaagacacttatcaagcaatagcataaatgcttctgacacca      13090
tgactctaatcagagtggcacagccaatgggcatggggctaggagaatatgagaattcgtaggtatgggg      13160
atgctgtcagggttcatgaaaggtcttcccaatgatgagaaaactgcaagttgggaggaggtagaaataa      13230
ctgaaagaaatggttgtagagatgaatacattggggagtgatcgtgttgcagggtgacatctttttagtga      13300
taaaagggatagagtttgagctcctgctgcagacccctcagcgatgtgttgtaatggtaagaattggctca      13370
tggtttcctggtttgcctgattgctgcatccacaaaaccatgggttctggggttaattcccatccatttt      13440
gttgctgaatttctcagaatgatagtcttcggtacattgttactgaaaggaggtgctaaacccaatgtct      13510
tcattgcttttgaagcagatggtccagtgtagtgtttctcaaacataagcatcagagttgtcctagaggtc      13580
ttgttaaaggcaaattgctgggatccatcccaggagtttctgagtcagcagatctgagatgggaccoata      13650
attccccagttgaagttgccgtactggtcttgggatcactcttttagaactactgccttagggtatttc      13720
tgggttacatgtgcacacatgacctgcttaagttttgagctcaacattctgtttattccttcctgttca      13790
gaggccggcatccacagctctgggtctcatcatttgcttttgtcatccagttgtgctctactgatttat      13860
aagttatctttatgttttcagtttcccagtcaattcaagccaatgcatattttattgggcatctaccatgt      13930
gctatggactgtgagggacttaaagattaataacaacaaccataaaaactcattgacgtgctggcatta      14000
tttatttcccccatggccccccaaatgctaggcttatcattcaaaacactacagcaacttgaaggcagcaga      14070
ttgtttctcatttcagggatccacaggtatatggcttctcaaacgaaggtctggtaattccaggctgcat      14140
gcagctattcttcctttaaagactgagaaaccatgcatacaacatctttctctcctcttcgtttataca      14210
tttgataactatgtactgacatcttacttgagaaggtcaccatgccagataccgtcagtgatagaaaca      14280
cagataagattcaacctctgatcccagggagactctcagtaaggaagagaaaatgagaaatgaaagtacc      14350
tatactacaaggcatgcacgtcacacattccataagtgggtaaaaacacagaccttggcagcacagaatc      14420
ttgttttccatttgtgtcatttaggacactgcattggttatctattgctgcataaaaaattcttctaaac      14490
cttaggttaaaactgcaaacatttatcatctcatgcatttctatacatcagggatttaggagcagtgtag      14560
ctggccagttctagctcaggggtccgtcatgatgttgtggtcaaggttgtagacagggcttgcagttttatg      14630
acggtgttggagaatctcacttatgtgtcacttggcaggaggcttcagttcttggccacatgggcttctc      14700
cctagggctagacgtgtgacattaacagctggctttctgaaagtgaggagagaaagagggaggctgaaa      14770
gagagtctaaggtgaaagccacacactcttagaacttgatcttggaggtgacaccttgtcacttttgcac      14840
ttgatttggaggtgacaccttgtcacttttgctacatgctattggttgttcaaatcaaatctggcaccat      14910
gtggatgaggcatttccaggaaggtgttaattgcaggtgtcagttggccagtaggctcagaagctagactatcacc      14980
agaagctcttccaaaggaggtggcttatgagctgcatagaattttgtcataaggacaaaggagaaagtgt      15050
gaacaaacacataggtacagcaagtgttgaggaatgggctgtgttgtgttgagtgttgtctcaagggcat      15120
gttgagtttgggtgatgaaattgaaatcagatcatttcaggtggtgcaacttgatggtaagccatataga      15190
tgttattctgtaggcaatgggcaatcatattaggacttttgcagaattatttaaggaatagcagtttca      15260
tgatagtagaggtagggatagaagacagaaggtcagtaatgcaagttgagatctagttatagattcaact      15330
gtggtagagattgaggaaatggggatggcatgaggctctgcagaggcattggaaggatgatactgataga      15400
atcttgcaaactattggatagaggccaagacaatgaataaccatccaaggttgcagttatgggtggagtt      15470
gtccagttaagaaaagggagagagttcagaggtaggtgaaggtcagcattattagatgctttggagacac      15540
atgagactgacagagatgtttactattttttttggtgattataaggtaatcaatagactttgagagatta      15610
ctgttttcagtcttccatattatgttgcttggatgcattttctttttttcctgaaacttggcagacata      15680
tccattatcaagacgttttcagaggggcatggtggctcatgcctgtaaatccagcactttgggaggctga      15750
agcaggattgcttgagctcaggagttggagaccagccggggcaacatggtgaaactccatctctacacaa      15820
agtacaaaaattagtcaggcatggcagcatatgcctgtagtcctacctactcgggaggctgaggttggag      15890
gattgcttgagcctgggaggcggaggctgcagtgagccagatcacactactgcactccatcttgggtga      15960
cacagtgagacccctgtctcaaaaaaaaaaaaaaaagaaataaataagaaaagaccttttcaaccattcaatca      16030
taattccaagaccctattgtgtcctgactcaagagcaggtactcttattgagaaacatttctgtaattg      16100
ttcccacttccttatccttttttctgacagcaggtggcatccctcagttgtctagctgaccactgg      16170
aagggctgaccoctcaacaaacccatatcctgcttggagtttctctataggccctgtcttatttattgct      16240
cctgctttgagtaactttctccttcctcaaatctattcttctaatttttccttcactgcctattaattgaa      16310
ctgactttctgattgtctgttcctcctgccttgcagttactgtcgctccctaaattccatcctcgaat      16380
cactcctcttcctttccgtactgtcctatgtagctttgcatctactcatggtttgatgattatttccatcg      16450
gagagaccacaggggtctctatcttctgctctcacttctcttccaagttcttcctgcccttacagctcc      16520
cctttcaacaacattgcctatatgctctggccaaaactcaattcagtgttcccaaaattgtcccatcatc      16590
tttcttgccaagcttaccctgctccctgctcatggcatcttctcctctcaattcctcatcttggatttga      16660
atcccctctcttttcccatccccagtgtaaatcactttcagaaataacaggtcctgtcatttcttcttctg      16730
agatacatctgtactttccttggtcatcttctcactttatgtgttactattttaatcatatcctgtctat      16800
gacttgtacactctccaatctattttttaaagctattcttcttcatcttcacaaataattgattatgtaa      16870
gactactatctcgttcaaaattcataaacaagcatccactgtgcttcaccacctgccccatctccgcccgt      16940
tacaactgcagtcatcattttactcctctgggtgttatacttcatcctccacccaacctgagtatggata      17010
ggaatcactgcatttcaacctggtttcttgcttttctcattcttctcaggctcctcatttcttcaacctggaat      17080
actgttattttcccatctccacacctattcatgactgagggctaaaatgctgtttctttcactgctctc      17150
tctaacatgcattgtttgtattcctctgtggtagtcatcaatttccattacagaggccaggagacctgat      17220
actttcttgagtgtgaattcagtagttgacgtcttgtgtctcagtttcctcagctgttgagggctgtga      17290
gaagagtacctacctcgagggatgtttgcaaaataaataagttaaggtcaggcactgtggctcatgcctg      17360
taatccaagcactttgggaggctgaggcaggaggactgcttgatcccacgagttcgagaccagcctggc      17430
```

FIGURE 8A-7

```
aacatagggagaccctgtctgtacaaagaataataataataataaaaattaggcaggtatgatggca          17500
catgcctgtgatcccagctacttgggaagctgagacaggaggattgcttgagcctgggtattcaaggtta      17570
taatgagctaggattgcaccattgcactccagcgtgtgtgacagagcaagatcttgtaaaaaaaaaaaaa      17640
aaaaaaagaaaggaaaggaataaattaagcatataaagcactttaaaacaggtatttagaaagtgttga      17710
aggcggccttgacattacttatctttggcccatccttgtctttctccttcgtagtctaaaatgttttaca     17780
aaggactgtttctcatgacactgagaatgaaccccaaattcctttcactgacctattccacttttataca     17850
gtaagcctcttgctcacttctccaccttcatcccaggccatcctctctcactgaactgctgtcccagtc      17920
ctcttttggttttgtgatctgagtggataccgtgttaggacatttttgtgtgccactccctctgcccaga     17990
gcaccctgtcctgttcccatttaaagtgggttccacccctcgattgtgttcttatttaacccattatttac    18060
tttcttctctgagctcacctgatctcaaaggcttttttattctttgtctacttatggatatgtgtggagg     18130
atctgggggttagtgaattttctctgcattctctaaacatgtgtattgcatgaatctggaatagatca       18200
gcccttactgggtatttattaaagaaatgagtagttgtaagacactctatagatattcatttaatgaatg     18270
agaaaatcaaatgttgcctggtaaaaacaagtgttaagtcagctatcacagtttctgagatatgcagcc      18340
aagccaggagactgagggaaggatgtctttcattgtaaaatcaacgcactgtagggaaagttcctctc       18410
tcacctaagggaatatcgatcttccttgattgtttgctttggtatttctaaattagcatgatttaccaaa     18480
aatgtttggatcactcagtacatgcatgtgatttttctaaatggctatctttaaaaaaacttcctcatc      18550
tgtattaatgtccctagagttttttacattttttgcctgtatttcattaaagatgatgtcatagaaaattt    18620
ttgtcaaatttctcattctggtccgtgcctgaagattgacagtgatgcagtctaagaaagttcaggatt      18690
ttgaggtttaatcatttacattctaacactaaagctacaaatctgccgtgcagtgttgcttacttctact    18760
gctcactggatgatgagtctatgtgctttttaaattccttataaagatgtgggtcaaaactagcagtgt     18830
ggtcaataaattaatttcttgagagtttatcagaattgtgggatgatttgggaggagcaaaattgtgtaa    18900
aatcaatcctctatttttaaacttattcttctaaaattctaaatagaattttttttattcattaatatttt   18970
cttgatttcataatgctaaaaattaagtaagatgaatgttgtgttgagaaatgggagcaaatccaagacc     19040
aaaaatcagatgatttattaaatttgcaagttaaaaaaataaatacagtttgaaagattgctctgtttga    19110
ggaaaggacatacaattttgttgagataacttagggtacaaatcaaggtcatttatgttcatttgaacat    19180
tcatattcacatccggaaatatccagaatgactacactaaaacctgcaggtaaattcttttctcagctga    19250
gcataccatattgttgtagttaatcaagaaatctaccaaaattaaatttgtcctcctcacttttagttta    19320
gaaatttaggggggtcactgggactcaaaagaaaattcaataaataatggaccatcctagagatacttctt    19390
tttaacttaaaaatccctctgagatatcctcaggtttaaaaataccttttgtatttcctgttttttgtgt    19460
gtgtttgtgtaggcctacatcttcatattagtcatcagtgttgtcagaaccttggctagaatcatagtct    19530
agacctcttgaggtcactgggtggttggctacattttccacctcttgcttttcatgggtcccactctgag    19600
aaacatgctccttctctctctcctctttcaaggtcatctttgaggacatcttctgaagcttttttctga     19670
gatgctgcctcttctgagcacgacactgtctattcttgtatcaccagtataggagctcatgcaatttgta    19740
agcacttgccttaatgatgcgctccctgaaagaccctgaggagagggatcaggtggcgttcatctttagg    19810
atcccttccctgtcctcacagcacattcatggtccacgttcagcaaacacttgtacaatgacatgactta    19880
gggtttctagacaatctgtattgtaatttctgttgatataaagggataacattagcatcatatgaaaagt    19950
cagagttctatcaatgtcatcttgatgaaaatatttatatcgttatatcttatgtcctaggtgtcttctt    20020
gactgactacccagggcgagttggaatggctatgtgcatctctctgaaccccccaaatctttagttgtaat   20090
gatgaacttacatggagaggcttattcgaaacgtcattatagtgtggatgataaccttcttagtttccac    20160
agctgatattcctccaaagttttgtatgctttgactaatgtattctctttatgctaagctttctttaaaa    20230
tgatatgaatgttccataaatgctgattttttttgttttttgagacagggcttcactctgtcacccaggg    20300
tggagtgcagtggcgtaactacagctcagctgcagctctgctcctgggctcaagcaatcctcccaccta    20370
gcctgtggagtagctgggactacaggcgtgcaccaccaaacctcgctaattttgtatttttttgtagag     20440
acagagtttcgccatgttgcccaggctggtctcaaattcctgagctgaagcaatcctccctcctcagcct    20510
cccgaagtgctgggattacaggcatgagccaccacgcccggccccataactgttagtttaattagcacct    20580
ttctgctttagttcatgttgactattgaaaatctatcatcctgtataattaatgttttaaaagatactt     20650
ttagatagtgatcaaaaacttatttattaagtagaatgtaaattattacaaatgatatgaataccataag    20720
ataaagttttttatatgacaacttagattaaaaatgcaattctagccaggcacattggctcatgcctgta    20790
atcccagcactttgggaggcccagcaggcaccaaccgcttgcttccaggagttcgagagcaaccaggca     20860
acatagtgagactccgtctctataaaaaatacaaaaaaaaaaaaaatagctgagcatggtggtgcatgc     20930
ctgtagtcccagctattcaggagactgaggtgagaggattgcttgagcctggggaggttgaggctgcagtg   21000
atccaaggttgcaccgttgcactccagtctaggcaacagataaatagtagtacaaatggcgatcatctt    21070
catattaatatgaaattgcatttttttgatacaggatctcgttctgtcttgtgccttctgtaataggtta    21140
tcttgtccaaattctggaataaagtccagaagaattttaatctagataatttattcttttaaccttgaaa    21210
tattgtatcagctacatgacaatggcttataactagctcaaataaatgaaataacgtttgcgagagtga    21280
atcacatcactgagaaccaagggggaaacatgaaatagtgattatttgaacagagagtgttagtggtctgc   21350
attctgccttgcaccccaaatggcatcacctatgggtgtgataaaaagccctgccttttctctccctc      21420
agtgcttgggatttccaacaacagcaaaagagaagccaggaagaatgctgttgtgagtaccccagga       21490
agggttttcctttatgagaggcagacctagttaggaaatacataaccatggactgcaggaaagacagtt     21560
gagtctgcatggaggatagagaccagggaccccataaaaggagaggtggtgaccgaggcctgcaggatgc    21630
atggaaacattcctgacctcaagggcagcaactgtgaacacactcctactaggcagaactagaatggatg    21700
aacagagttctttcagggagagctcaccaggtagatgactacacatgagacactttttttcttttttttt    21770
ttttttttttttgagacagagtctcgctctgtcgcccaggctggagtgcagtggcgccatctcggctca    21840
ctgcaagctccgcctcccggttcacgccattctcctgcctcagcctcctgagtagctgagactacaggc    21910
gcccgccaccacgcccggctaattgttttgtattttagtagagacagggtaaaccgtgttagccagga     21980
cggtcttgatctcctgacctcgtgatccgcccacctcggcctcccgagtagctgggattacaggcgtgag    22050
ccaccgaaacacttcagtgggaatattttgttccatcagattttagcaatatcggattttgaaaataggg    22120
gaagcacacacagatacaattagtttccaccatctcacttgtgtatttaaacaaacctgtaaacaaagcta   22190
agcgaaccaagaaacaaacaaaacctcaaacctaatacagtaataataggctgggggtggtggctcatga    22260
ctattattaatctcagcactttggtaggctaatacagaagaattgcttgagcccagagttcgagaccagc    22330
ctgggcaaaatagtgagatcctatctctataaagattatttaaaaaattagccaggtttcgaggcatcca    22400
cctgtagtcccaggtacttgggaggctgagaggcaggggatcacctgagcctaggaatttgagattaca     22470
gccagctgtgatcgtgccattgaattccagcctgggtaaaagagtgaggtctgtctccaaagtaataaa     22540
```

FIGURE 8A-8

```
taagtaaaataataataataattttttaccgtatcacaaaaaatatagccagtcagatacaatgcacacta        22610
attattgtaaaattttctgaaacacacatacatcactaacttgataattgtaaatttaacactgattgga        22680
gggtgtgaacaaaggtatgatcaagtaaaataaatgtataggcaatttcaaagtcttaataatacaattt        22750
caagagctaatattaattgagcatttactatatgcacactcatgcatcatgggactgtgtttggtgctaa        22820
tatcacaaaactttattttttcttccactggtaattttgtcactgttgaaaactgtttcagccatggat        22890
ccccacagtgcggagattgcgggatgtgggagagaaatgatggtctcaatccccacctgagccagtgtcc        22960
tatggcaggcaggtgaaagccaagccacccagcttgagttctggctccacttttatagttctgtggtgtt        23030
gggcaggttagctaatctgtccctgcattagtgttctcaactaatggggataaagctcacatataccta        23100
tatgttttggagacaattaagagttagtatatgtaaagaattcagcaagttagatgctgacccactatg        23170
tacatattagctattataacttattattcggacaaacagctaatgcatgtggagcttaatacctaggtga        23240
cgggttgataggtgcagcaaaccactatggcacacgtttacctatgtaagaaacctgcacattctgaaca        23310
tgtatcccggaacttaaagtaaaataaaaataaaaaataaaaaaataactattattactactattattag        23380
aattgtttggatgaggaggtagcttgatatcttgaaaaaatgcatggtctttggagtcaagataggtctt        23450
actccctgcttcagtgagctgcgttacttaacacctggatatcatttttttcccaatgtaaaataagatg        23520
tcataataactcctgcccttggctgtagaagggtcagtgaagatgaatgttattatgattgttgttaaat        23590
ataaattcatttttacaaatacagtttcatcaacaatatttatgataatgcctattaataacaaaatgtg        23660
ctaggtgttatgagaaatcaaaaacatagttaaaatatgatcttgtcttcctgtaatttaataatgtgct        23730
ggctcattagctatgaaacccaaaggccttatctactttgtattaatattttttcaagcatggaagtaag        23800
cccagaagggtattgagtgatgtatcctcttcttccttaccatctttcctatagatgcaaaatcctgag        23870
tgtgaaaggccacgtggtactctgttagatatctcgcaggtgttacttatcgatggttcttgcttaaaag        23940
tagaaggaggagtgtcgcatgagacgcatcctataaagagagcattccgggtgagatggcaagaaaaact        24010
ccgaatggtcctgagatgataactgatccaatggagatgatatatctgttcagttgacgcaaacataatt        24080
gcggtttatacccgtgaatgtaaggcaaaaactgcaattacgcttgcaccaaccataatatatatctt        24150
tggagacagggtcttgctctgtcgcccaggctgtagtgtagtggtgcgatcacagctcactgcagcctca        24220
acctcccaggctcaagtgatcctcccacctcagcttcctgagtccgctgggaccatagacacatgccgcc        24290
acatccagctaattttgagataagttttcttgcagtagagtcaatggcagtgttgttctgaccttctgcc        24360
acagcaaaacatctctgcaggttgaggattagttcttgcaaataagtgatttctaaatgattgattggtt        24430
cttttcacacattttgcagatttctttattaaacaagttatatctaatggagaaatacagtgagttgat        24500
gatctccaacaaaactttaatgccaaccagatcaatgccaaccagattatgagttgcccattggaaacct        24570
caaggagtcttcattgattttgtattctcaaactgcatgtgtgtgctaaaatggttgcatagagattcca        24640
catgcagccatgcatgtgtgtaggtgctcccactagactagttccttgacttattagggaacaagttaag        24710
aattacttcatgtcatgatcggctagttcttgtaactacccataagaaagcttataaggaatgtcacatt        24780
ggttttgaaacaatatcatctcttttactgatggagagaggtatgttttttcttttttttttaaataggg        24850
aacaatgtgctaagatggaaaaaaaaaatcaagtaggtttgccagggaggcattttttttttttttttttt        24920
tttttttgagacggagtctcgttctgtcgcccaggcgggagtgctgtggcgcgatctccgctcactgcaag        24990
ctctgccttccgggttcacgccattctcttgcctcagcctcccgagtagctgggactacaggcgcccgcc        25060
actgcgcccggctaatttttgcatttttagtagagacggggtttcaccgtggtctcgatctcctgacct        25130
cgtgatccgcccacctcggcctcccagagtgctgggattacaggcgtgagccaccgcgcccggcccaggg        25200
aggcattttaaaggcaccatctcagaaggacgaggcaatggtaagtatcaggaatagttcattggcgagt        25270
ccagcacagcagtcaatgactgtgttctggactgcaccgttggactcgggaaccactgtgtggccaggct        25340
gtgggctccggcagttgttcaaaaccctgaacctggagctcagaccagagggttgtatgggaggctcact        25410
gtcattcattgtaaccctaagaacctcatccttccttgagcccgattgttcccatctgatcagagcttag        25480
atgcaagattgggaagaaaggtggtggagttgggggtctgcctggaggacagcccaggtgagtcatgcatg        25550
gctgggagagcagtaggttcattctcaccacctcattttttctaagggggaaacagatccacaaggggaggt        25620
cagccccagatcattggccacacttatgggaaacatgtgctgctgttacgcaggcccccttcattctgttt        25690
gcatgctctccttgtaaccctgggcctatcaggacgccaggtgtctgttggaagaggcatccaagaag        25760
gatctttaggctgcaggatggaagcacacactacagcatgaccttaggtagatggtcattcattacctt        25830
ttaatatcttcctctttctttgctgtcaaacatgggtaataaaatacctaacctgtcatattataagaag        25900
taattgaggccaggtgcagtgggtcatgcctgtaatcccaacacgttgggaggctgagaggggagaatca        25970
cttgggttcaggagttcgagaccagcctgggccacacagtgagacttcatctctacaaaaaatttaaaaa        26040
ttagccagacatggtgatgcacacctgtagtcccagctacttgggaggctgaggtggaggatcgcttga        26110
gctcaggagtttgaggctgtgtagctgtgattgctccactgcactccagcctggccaacgagcaagaccc        26180
tgtctcaaagaaaaaaaaaattaggtgaaaacaatgtctatgcaacgctcagtgcctggtgatgtctaag        26250
gaatgcccaaactttctaggtaaggggggtaggggatgcattgggtgagagtcccattggatgagcatgaat        26320
gggaactcatcaatattgctgaaagtgcctgatccagaattaaaatatttcaacagaaattcagaggaa        26390
actttagaatgctgaaaaatgccatattggtcagtcttactggttaatcgacttttctgaagtacataca        26460
cacttttttttttatttgagatagaatctcgctctttcatccaggctgtagtgcagtggcagaatttcagc        26530
tcactgcaacctccacctcccaggttcaagtgattctcctgcctcagcctcccgagtagctgggattaca        26600
ggcacccactgcaacgctcagctagttttttgtattttttagtaggggtgaggttttaccatgttggccagg        26670
ctggtcttgaactcctgacctcaggtgatctgcctgcttttgcctcccaaagtgctgggattacaggtgt        26740
gagccacaacttccttcccacccagctaattttttgtattttttagtagaggcagggtttcaccatgttgac        26810
caggctggtctcgaactcctgacctcaagtgatccatccgctttggcctccaaaagtgctgggattacag        26880
gcatgagccactgtgcccagcacacacttcactttggatcaagccccctttagagcatctgaacttcttt        26950
tccagtcccttgttccacccaggcaatcccaagcctggtgccttcctatctctagcctttgatttaggct        27020
attctgtctgcctgtgtgcaacatttcctttccctccttactgaagttctaccccatcctgtgttgcatg        27090
agttgatggataattttgaaaaaataattattggtaatcattaacctctactgacttatttcattgatgc        27160
atttttgagcctggttaaaccaagtctagcagtgctttcggattactttggtggtgaaaattgtttactt        27230
aaaaaaaaaaaacaatttgaaacaaataaaagtagaaagcagtggttcaagctcatttggagtgtcca        27300
aagtgacatgcctggaaatttaggattttgaaataattgtctgctcctcctcatggccacacttcggggt        27370
acatctcataaagtagacaaacacagatgaagtgcacctgtctgactcactgtatgtaaacctctcagaa        27440
attcaccccttggctgcactgctcaccggaagtccattttcttctagagtaaagatttgcaatgatctagg        27510
actcaaaaagtccatcttgggccatttgaatgaccccagcatctcattttacccttgtatttgtagccc        27580
ctgcagagtgggggttcaaaatgtcagacaggtactactagtacaggcagaggggacactcagaccatgag        27650
```

FIGURE 8A-9

```
atccttctcactgtctggacattagaaagagagcagagcccaaggaaaagatatgggtagaatacttttg     27720
tgatatacagctgtgagcccatgttagtggagatatttcacaattgaaaatctggacccttccccacaaa     27790
ctcaaattttagaaaggttcatctgatgctttcatacatctcaagtaaatggctctgtcttttcatggtt     27860
cagctgcaaatctgaagtctttacaatttgattgcttaaatattggttattgacaaattttcttatcaat     27930
ttgaatgttgtagcttccaaacttttgtcaaaatttagaccacaaaggccttttgagtatctctttaatg     28000
attgccagataattttcctatccatggctttctcttttacagaataaaacttcagtattttccttgattc     28070
tagaagattgtcaaggtcatgtccttttatggaactcttgtttccaacaaagtttgattttttaaacatctct   28140
ccatatttcctgccataaacaaatactaggttttgtttttcaaagataatttgtaatttataaagaaaga     28210
ttaatgctgtcccacctcccccatttgatcattaacatacaaattggaagaaaatcatacttggaaaaat     28280
gattgatcagctgttttgctattttatctagtatagatttatttgtcttatcaaaggtaaaacgaataaa     28350
ggtacacatcattttttcatcagcatatacagctaaataatcaataatgatacattatgtaaatcccttg     28420
gctcctgaattacacgacttttcttttttttccattttctttttttttcaacctggatgagtcttaataaata   28490
atcaaggcctgaagtctaagaaatgtttgtcttctctctcacacttttacagcctttggaacaggaacccaa   28560
tgcagcattggttgtaattatttcagtagctgcagtgcaaagcacattcaggtgaatataatcagactgt     28630
cctagttccaaggagaagcagtagtaacaggtctggcatcaggctcagagctatagacgagtcacagctt     28700
ataaatgatagactcactttatgaaacccaaagggaacattatataaagtgcacaatcatgagaaggaa     28770
atgagaacttctgaacctaggacttttttaaaattgttttaccatatgcacttaggttcaaactacattt     28840
gaaaccactgggcattatcagtatgtctctgcaagagtcagctactgcttttgcttaattggtagctgca   28910
ttttctcttaaggggggaatgctttggagtgtgttttcctgataatttggagtggtctttgctgaatggt     28980
gatcctaggttggaatttcctacattgtacaccaagaatcagttggctggataaaaacaagtgacaaag     29050
ggttttcctttcccagtattctcaaaatcctcagtaagaactgaaggcatcatgactcttcagtgacat     29120
cagttgtccttgaggaggggtggaggatttcgtggagacacacataggcctgataatgaggacatctatg     29190
ctgtaatccagctctgctgctaattagttgtttgcaattactaggtttttggtatgtttaaagactgcag     29260
agacaggcattcattcctttcactatgaagaatgtgtgaatgtaaattaagaaccacagctagctgaga     29330
agtacaaataatttgtgaagcctatttaatactcgaaaatttcaatttatgtcagttcattcaattttttc    29400
tacatacagttgactgaacactttctggttttgtaaccccctattagggaaaattctttgcaatggatttt   29470
catgataatctggatagtcttagtgatcttatgttagaatttattttattgctaggatgacttagtccaa   29540
ttcaaaactgatgatcaagaaaaattccttcatggcattcctgaaaacataattttaagtcaagggat     29610
gatcaggataattctaggggcctgtaagtttgaacattgagattgttgatactaagttctgaacacatat     29680
tacccaaatgaatcttttattaaacatttgtgtggtttcaaaggacatagagtagttatgcaaatcaatgt    29750
ggtgcagcaactacagtataaccttcagatgttagggaatcaacgactaaaaaaaaaaaaggacagtatt     29820
tgaatgttattacaaagacacctgcgattcttgaaggacatttcaaaggcagacaatggggtaaattgtg     29890
attgaaatacacgcgcaatctctatgatatgctcctctccacttagaaagtgggatgaaagctcatcaatt   29960
gaagagtaattgctaaaaaagatttctcctctatccagcttgggagtatttaggagctaatcagagtatt     30030
tcgtcttctcggaaattaaaagagatgaacagagttgtgcagacatggggaaaataaagtttagtttaat     30100
atttagattttaaaattagtacttgatggacattttaaaaagtgtacaattatcaaaacttcaatatcta     30170
atcctttatgtaaactatggtggatacatggaaacaccagggacgggtgctggttcttgttaacttttc     30240
ttctctgtcagccacaagagtgcctgtcccatagcagtaaacataatgtatttgctaaattaagaagt     30310
gggaagggcgttgtaggttattgatcaaacgaaaataaatatatttttgttgtttattcaaaaatttcccc     30380
gacttaatttttttaaaatgtaacttaatttttttaaagctcatctgtgtttctttgttttgtgtcgagtc     30450
aaagattattttatgtcaattaccttttcatgctgaggcaacagtttcagttttcccattctgcaaaact     30520
aatttcctgattcctctctcaccagggaccattcccctccaaaatcctacaaggtgggtccatgacatct     30590
gctagagaaaagagggacatgttggagcgataggattcccatgggcactgacatactggcctctgggga     30660
taggaagattaatgcttagtacaagaaagaaggaaaagaaggccttggcgaggactgttttatctcagca     30730
tttctcagaagctccttcagtggagacttcgcctgggaccttcgcccacccttcttctaatggcacttcc     30800
tccctgtgggctccacgcgggacattacgtcggtgatgcgtagggcatcgggtgcggaaatgtgtgcgt     30870
gcctcctggcgtgtgcgtgccttctggcgtgtgcctgtgcgtgtacgtgcgcatgcgtccgcctcccggg     30940
ttcacgccattccctggcctcagcctccggggtagctggggctacgggcgctcgctttttttttttttt     31010
ttgtatttttagtagggacggggttcaccgtgttagccaggatggtctaggaaattttaagccactct     31080
gactaaagaaggtggagttggccgggcgcggtggctcaaacctgtaatcccagcactttgggaggccgag     31150
gcggcggatcactaggtcaggagatggagaccatcctggctaacgcggtgaaaccccgtctctactaaa     31220
aatacaaaaaattagccgggcgcggtggcgggcgcctgtagtcccagctactcgggaggctgaggcagg     31290
agaatggcgtgaacccgggaggcggagcttgcagtgagctgagatcgtgccactgtactccagcctggtt     31360
agagtttatattttcctttaaatttctagagaaaacagattgtcatgtattttttatagagacaaaatactg   31430
atgaaggtgatatacaggtagcttaattatgattttctaagatttaattagatggtaaatttacagtaa     31500
ttattaatatgttcactgcttttattaaaaccatcaattctgaatccacaatgacacaaatggtgagta     31570
aggcttatgtcttgtatctgtgttctttcagtgcttaaatgtcaagagaaaaacaaagacttttaacatg     31640
attttttaaggaacgttttcattctatggtggtttctaatgtatgtgtttgtctttttagacttccttatcc     31710
ttttcctttcatctcttttctcaaactcataaggttttccttttgtcagatacttttttgcctgttttttcct   31780
ccctagtttatgctgcttttctgtcaagaggctatatttcagaatgggaaaaaagggcaagcatatatag     31850
ttaaatgaatcattttacactgtttgtaagttattatacataagctaatgtttgatctctggaggataaa     31920
aatgagctcaagtttgagcaaatgatggtgccgcacacatgccctaccttatggtgagtcaactatggcc     31990
tatggtggtggccaatttttgtaaataaaatgttttgcaacccaaccacacacttaaatttacattttc     32060
atatatggttctttatactacagtgccagagtggaatggttgcccccagacactgcatggcctacaaagc     32130
ctaaaatatttatcatgtgatcctttaccagaaaacattggcaatgcatactttggcaattcatggtgat     32200
catcttgggcctatgagttaatgcatccgtgcatacatttttaaattagaaatatgtaatacattagcatt     32270
aacaacagagcatatgcttttgtattaggaattctatgaatgcatgcactacaactcttaaacacagagc     32340
aagtttaaagcctggcatctgggtgtatggatgagtggggcctgggaacacccttgaattttacctgta     32410
aaatttatgtgcaccagggaaagattcagtggcgttcaacaacacaagaagctgcagctggttcgtgtgg     32480
gttttcattggtggtctctagctgctcaagtgatggattccagttgctggttgatctctcttagggctaa     32550
ggttcattattgcacagattgatcttggagaaacatcttgactgtttttttcacactccaatccatttgt     32620
tttatgatctagaagaaaggaacgcttaaatgcaaacaattattgtgattttttattccgcttcactgaac     32690
tttttaatgaagtgcattttgtacagttaaaaccagggggttcctggattctatttttttgtgggaatttt     32760
```

FIGURE 8A-10

```
tgagagagaagtaattctgactcagtacgcttccttggagtggataattaatattaatggggaatggaat     32830
tgttttgtctttcgctggcatgttgttctctgccacacctggcatgctgtggacctgtagtaaatattaa     32900
ctaaatatattttagacacagatgattaaggatcttttgctgaaaaacattctcttaatctttatactt     32970
ccctttccacagtgcctgctgaaaacatgaatttcaattgtgtttctaagtcttggtcaatttaagtgtg     33040
acatggggtgatggggaaatagccagttaggactaaaggtagaaggtaacatgatccatgtgaattgtggt     33110
cagtgcaaaggcctggaacagcggtcactcttttcctgtccatgaacctttgtgctattcctctttgtaca     33180
cagtttaaaatataaataagaaaatgtcatgctgccaagtatgtatcacagtgcaggccacgtagaagat     33250
gctttatatgtgttggatgcaggccagtgttctcaactcagcagtttcagaggaagtgaaacaagccctg     33320
gctggaaaccagtagccgtaaggtctaagtcctggctgagcagtccaaatgggttccctaacctattgcc     33390
catcccctcagctaagaagggcaggcagtgcccctgggcaatgctggttttatccaactctcagaaggcg     33460
ccattctttgcctacgctctcccgtgtattggtccaaagcccaccaacttcctgagtggagttccttcac     33530
attctgcagaaaaccttctgtggtgctttaacattggatgggaagatgaagttatcttgggctctgggct     33600
atgttagtcatgttttggtaaacgaagcattctgttttcaccaggggatgagtaggtataattttccttc     33670
ttgagttttgcaaacctgggtggagaagaaaatcagtgcaatgtcttatgaatttttttttttaatagaag     33740
atagcaacttggaagcaattgagtgttgagctaagagattccccaccccccccagcatttgttctgatc     33810
tcatatatatgtacagaaaaatataaattatttagcattgacttatctgtaattaagtcttctaaaagga     33880
ctactgttttagctgctatattttcttctcaattacttggaaaattttaaaccttccttggggaatgttta     33950
gtcttttcacttgtcctttttaatggtaattgattggattgttcaaattatgctgttctgagaagaagttaa     34020
caaataaaatctggcaaagtaataagcaaatggcatcaggtaaatgaaaagaacagcacactgtgtccag     34090
tgatatgtgtcttcactaatttcttacctttcaaaagttgaagattgataatcaaggtaaactttaaaat     34160
ggaaaatttgccagctacagattttaaagttcataaaaggtggttttttgatagcttttgttgctactat     34230
ttccatttagcctttttataataattagttaaaaatctcaactaattcttttgataagatatcataggttg     34300
tattttcaatgtttaagccagatacttgcttaaaaatcagttaattaactgagagtgaataattgtcat     34370
ttattatttttatatttgaaatattaggttatagtttaaacatttttacttaaagtgtaactagaatactgg     34440
acacattttgctaacactcagtgttttcaggtgtttttaaaatcatcaccatttctatggttaagtctta     34510
gaacaacactcttgaaatgatgtggcatcaaccatctgagaaagtaattaaaagggataaaatagtaccac     34580
atgagttgggattccttgactatccaaccaaaaaattaccgattttaggaaacattctatttaatctaat     34650
tatccttcaaagtgagtggacctttgacgtcattttcaacagcagtgccatcttgttttttgtgtagttga     34720
agatcagttcattgatcttatgtctcaggaagaaattgcagtatttctttttttgtcttttttttttttga     34790
gacggagtcttgctctctcgtccaggctggagtgcagtggcgcgatctccgctcactgcaaactccgcct     34860
cccgtgttcatgcatatctcctgcctcagcctcccaagtggctgcagcaggcgcccaccaccactcc     34930
tggctaattttttgtattttagtagagacagggtttcaccatgttagccaggatggtctcgatctcctg     35000
acctcgtgatctgcccgcctcagcctcccaaagtgctgggattagaggcgtgagccaccgtgcccggcca     35070
gtatttattttttggtgtttaaaaggttaaactgctttggaaagaaatttcaaaatgatttgggttttc     35140
cgggcttagaaagcagactccagctctaatagtatatgcttttttttctacaaatgttttccactagatgg     35210
ttatacagaatcgtttcaattgatttcttttctgcagtgcttctctatttggaaatgcaagtttcacatct     35280
aatggacactttctagcagccctgttcatccctcctgtatacttcttaactaggattccagaaggagca     35350
gtcacatttgttttttccttactttccactccttcttcagcatgttcatgttctcagctgtaacacataat     35420
cacaaacttaatggtttgaagaacactcattggtaaacatggttctggaggccactttctgaaatggacc     35490
tggtggagctacaatcttagtgtcagcagggctccttccttcggaaggctccaagggagaatctttctcc     35560
ttgtcgttttccccccatggaggctacctgcgttcctttagctgttgtggcaggtcacatctccctctctga     35630
ctctgaccctcctgcctccctcttgtaagggcccttgtaatgccactgggctcacccagctaaccagga     35700
tcatctctttatctcaaaatccttaacttaatcacatctgcaaagtcccctttgccgtgaaaggtcacata     35770
ttcacagactctcggggattaagatgtggatagctttggggacagtgcattatcagcctcaggatgctat     35840
aatcgtatgattcatgcatctcaggggtcatcttagttggcctctgcaacatctttctccctcttgatac     35910
cttcctgggatgctttcctcaacatctttgacaacactcttgttttccctttttctccctgatggctgc     35980
ttttctctttattttccttcttcccttgtctctttccctcctccttgctccatctccctgggaatccca     36050
ttgtacattgtatactcgatggaaggtatgtttggaatattatcacgtgtgtgaccaaagactgatggcc     36120
agtgaaatggtcttaggtgatttggccctaagttcccttttctatcccatttcatgacatctgtctacat     36190
atcctgtgtctcaggcatgttgaaggacacacaaccttctggtaccagcagtgtttagccacagacctcc     36260
gtgtcactgttattgctaccttcctcccttgcctgacttttctccctgcagtggagtcctaatgattcc     36330
acattcacctgaaagtcatttctcaagggagccttccatgacctgctccccctctataatcatgtatcca     36400
aaagagtaccccccatgataaccctcttttcctctcttgttaatttcaatgccttacttcctaccagacta     36470
aaaattcccctgaatacaggaaatatcttacgttattgtaatcaccactccgtctaatgcagtgccccac     36540
tgctatggtttgaatatcccctccgaaacttatgttgaaacttaattctcagtgtggcagtattaagagg     36610
tgggcctttaagaggtgattggatcaagattaatggttaatgtgtaaaaggattaattggttaagaag     36680
aaggagagagacctgagcctagcactgagcccctttggctatgtgataacatgggccacctcaggaatcagc     36750
agagagtccctattagcaagaagcttctcatcagatgcagcccctcaaccttggacttctcagccccag     36820
aactttaagaaataaattccttttgttcataaagttactcagtttcagatgttctcttataagcagcggg     36890
aaacaggactactaagacacacagtcaaaaattatttattaaattaataatattaccataaaatcatgt     36960
agttaaatctgtgtttagagatagttccactccttttactctatcactttttaaatctacgtattcatgtt     37030
agttccgtggtatgagcgtctgtgtgcatagctgtaattatagtgtaatagattactaaagcagtcatga     37100
aacacttgagggttctttgtaccaccgctcaaatttatttacatccatacacacttgtcaaaagaggtag     37170
agagtttcagatgcccttaactatccttattccccacaggcctaccctcatatttctgatagcagctgat     37240
ataccaggagactgaaaattaagttccatcctaagcacagagacttaagagttgctgtcacttagagag     37310
agagagaagcaaactattggtgcctccgaatgcaatattggttttcccaaagaatgcttttatcttcgct     37380
ttacttaaagaaaaaagcagggcagggcagtggaaatgaactgataaccttgtgtctgtggatataactc     37450
tgctccagggaagacattaaagggtaatgctttgaaaataacatcaagaaatgaaagttaacataaaaaa     37520
aaaaaagctgtcagtactttaggtgttccaaagtcctgtggagagtggcttaactggagtttatagcaac     37590
tctgagacatttttttttagtacagttctgccactactttctatgtttataaacaatgaacagatgcatt     37660
cagtgctagttacctagaatcaactctcatacccagcattacactcgaacgttgaatgttgtattagtcc     37730
gttcttgcattgctttaagaaaatacctgaggctgggtaatttataaaggaaagagctttaattggttca     37800
tggttctgcaggatgtacaggaagcataggggttttttgcttctggagagtcctcagggaacttacaatct     37870
```

```
tggcggaaggtaaaggggagtgagctttcttacatggccggagcaggaggaagagagagagggggcaa    37940
ggtgctgcacactttaaacaaccagatctcatgagaactcactcactacagtaccaaggggccgat     38010
gctaaaccattcatgagaactccgccccatccagtctcctcccaccaggcccaccacctccatcactg   38080
ggaattacagttcgacaggagatttggataggacacattttcatcttaatttgtattttggtatagttt 38150
cataggaaagatttaggttggtgttctctcgcatggaaattcacttagagcttttacttgcttgttactt 38220
gttttaaagccttcccaattgaaccaatttattaagggcatctatttaattttctatggtaaatgtacta 38290
aaactagaagagatcttactgccttgatactagtttgcttgtttattaggtgccctgaaaagataa     38360
ctttagcatccactgcttgctaaccatccttgtcttcagcatcattagaagatacgaaggagtaaggaac 38430
gtgcttatgagaaaacagaagctatggcatcccccatcatagccacatgagtcttgaataggccgcctgc 38500
ttctctgtcttcttttttgcaagtgggttgcatcctagctttggtggtgtccttgtaactttggaattgcc 38570
tttgagagaagaccagtctgtctcttccagctgctggacctgagagatttgggctgcaggtggcaaatgg 38640
tcgctactgagaaaactgaaagcaatgacagccatataatatggtgtgaacaccatatggatcaaactgg 38710
gacatcacagtcagcacacactcatccaattctcagaccaaggcacaccatgaaattctgacatttaggt 38780
ttcctgcctcttaggaattccatcaaaattatataagtagcactattctaaattttaacctactatcatt 38850
ttaaaaaatgacttactcacagccctaacactcatcggagcaggttgatattgtagaaaactctagccct 38920
atgcaactggagtgatcttgatgctaagcaaatatgacccaaagccttgtcctttcctcttggctatatg 38990
aatattttctaactttgtgaacaaaatatgcctcttttcctcatgatggtgtttcaaaatgagtcgat   39060
ggctgttttcagttattagtggataggagctctcttagcttagtccttcaaaagcttgtgtttgatgtt  39130
gtagctttgtaaattatctcaatgtatgcatacacacatactccccctaccaaaaaaggtcaatagatgct 39200
tagaattccttccttccttccttccttcctttttttcagggtcttgctttgtcgctcaggctggag    39270
tgtagtagtacaatcatagctcactgcagctttgagttcctgggctcaagtaatcttcccatctcacacc 39340
tcagcctctcctgggaccacaggcatgcaccaccacccgctgatttaaaattttgttttttttagagac  39410
acggttttcctatgttgttcaggctggtctcgaactcctggactctagtgatcctcctgtcttgtgctcc 39480
ttggattacaggcataagccgccacgccagccacgtagtatttctatattttacttttagcataagtcc  39550
gtgaaagaactatatttctcatgctttgttcaactgtgcacatcatgatgttgaaggatttgcacgatgg 39620
ctatgatggtggctgtcactgcactacaatacttttttttgaaaataagtgaaatattcattgttcactag 39690
aatagtcttacaggcatttgtttctttagaatttggaaacttcttttatattcatgtcgtatttcatt   39760
ctgctagcagtttaggcagattcaatctgtcccacttttccagtggtagaaacagtgtgaagaagtgaagt 39830
agttgttggaaaatcactgtggtttgcttcccaggggttgccttgtccactgattacaaaagtatcataa 39900
cacatggcatcttcccacaaggagtttagagtttgaaaagtcaatgtattaatgtacatagggggaccccac 39970
ttccactcaaagcaaacattgagtcaggtatcagagctcggtgggtgaacacgatggcatttaattatcc  40040
taaattacttttatataatcaatatctactaactgctttgttatgatgctacccatcattttgagtca   40110
caagctttcaacctttgtctaactaaaagatggatatctgcatttatattaggtggtctggaagccata  40180
gtaatattagagagcacataggaatgttttagtccatttgggctactataaggaaataccatagactgt  40250
gtagcttataaacaacagacatttattgctcaattctggaggctgggagtccaagatcaaggtatggcag 40320
attcagtgtctggtgagcacccacatcctggtttgtagatggtgccttctccctgtatcctcatgtggta 40390
gaagggtgagggagctgagttcccttttatgagggcactaatcccattcatgaggctccaaccctcatga  40460
cctcatcacctcccaaggacctcgcctcctgataccatcatcttgggggtcacaatttcaacataggaat 40530
ttggagggcacaaacattcagatcatagcagggagagagatgagccttgcccaactccatgaagccatc  40600
tagattttttcagtctcagtcctatttccatttttaatgttgagttttgaactctattaatgtctcctg  40670
gtattttcaaaactttgtagagcttttcatcatcaatattaaacctttcacattcaaaggacatgattatt 40740
ttgtgtgagtagcgtgttgttattttgacaaatgagtacaattataaataaatcttgaccatcttggagtca 40810
ggaaataaatgcacgtgtcaagatatactataatgcttttgtaatcaaaacaatgatgggccaggcgca   40880
gtggctcacgcctgtaatcccagcactttgggattacacccactgaggtgggtggatcacttgaggtcag 40950
gagttcgagaccaccctggccaacatggtgaaaccccatctctactaaaaatacaaaaattagccaggca   41020
tggtggtgcacgcctgtaattccagctactcaggaggctgaggcaggagaatcgcttgagcccaggaggc 41090
agaggttgcaatgagtcaagatggtgtcactgcattcgatggcgcaacagagtgagactctgtctcaa    41160
aaacaaaacaatcaaacaaaaagcaatgatggatagaacagggtatatttaaatgaaaactgtaagggg   41230
agttgtatgctctcaaatgtcattatgcacagtctaatattttcccttttactttgtcactctacctgct 41300
aatttgcttccttaattcagagttatgtctttggttattagttataatataggctgacagttatgtagcg 41370
tttcttctgtgctaggacctgttccaagtgcttttttatattaccttcattggtctcaaccactctacctga 41440
tagttaccattagtattagttttcctatctgtgctgcagtaacaagttactacagacttagtggctgctta 41510
cagctctagaggtcagaagtccaaaatgagcctaggaggctaaaatcaaggtatcatcaggacaccgtt   41580
ctttttggaggctctaggagaggacagatttccctgcctttccagattctagagacttcttactctcct   41650
tggctcataagttcctttctgcaccttcaatgccagtagattgagtcttctcattctgtcatctttctg 41720
gttcttcctcttttctttttccctttctacttataaggatctttgtgattatgtggaccccactggataa 41790
cctggaatcatctccccatttcgaggtctgctgactgggaacctttaattctacctgcctcttttcatttga 41860
atctcttttccatgtaaggtcacacaaagtcacaagttcttgtattaacacatggtcatcccgggggtc  41930
cgttattctgcagaccacacagttgttatcttcatttttacgacaagaaagacaaacagtgagagttaaa 42000
tcacttactcagggttgttgggctgctaaatggtagagccagttaaaattaggagtgtacacagggaagc 42070
taggcagtgttgtggtcaaggggccttggcccctgaagggttcaatgaaaaatcatggagacaaagtgatt 42140
tttactgtccactcaactggattgcacagaggggagagagagaccaggagccggctggctggtgagaat 42210
tcttacccttggccagcagtgtgggttcctgggttctctgcactgtggcttccaaaagagcagagcgtc  42280
tttgttgaccccgctcgctgtgtcataactgtaggggccaaggctcttactccctaaaattttaatgaa  42350
aaatcactgactaggcagactgattaacaggagaaatgacattacaagtgtatttaatgcagatacacag 42420
gagcctttgaatgaagatctaccctccaaatgaggtccagaagcttatacaccatcctgaggttcaga    42490
aagagtggggcttggatcccagtaaaacaggtgatgggaggggaggtgaggaattctgttgaggagat    42560
tattagaacagagattaacttgtaaagagttctctttgaaaattaaatgatccttggagacacccttgga  42630
aaactgtctgctcaggtgtggttttatcttgtttttttttttttttttctgtaatagataatgatataa  42700
cttgaagggggttgaaaaacaactgtaggttgtcaaatgtatcccatatcctagcccctcacttctggttcc 42770
atcttacttttctatgtaagttttcacttcctattttcttacttagaaattgtgttaatcactggt     42840
ataagtagcatctttgccagataaaaggaaaaacaaaaacaaatgctttatgacgatatgtgggagaaa   42910
agaatgtaataagtacttgagaaatattggaactggttaaatactagatggtgttgggtagtgtttaataa 42980
```

FIGURE 8A-12

| | |
|---|---|
| aatgattatatttcatagagaacatttctctacgctgaggcagaaatacagagataattttatactata | 43050 |
| ctcatccttctcctaatcatattatttttaaaattcaagttagaatttgagtgattgtattgctgctg | 43120 |
| tgctgttttctcagaggaaaaatcatagcaaattatttcaaagatagatggagaacatggtgtttctct | 43190 |
| atatccaggttggattgaatgttgtattagccaatggaaaccttcctcttcaccctctggagggtcacgg | 43260 |
| aaaatcatgtcacaaaaggcagattaatagaaagcaatacatatttattaagttgtagatttgtgtaaca | 43330 |
| caggagccttcagaatgaggacacaaagatacaggggagactgtccaatttttttttatttcaacttat | 43400 |
| tttagattcaggggtacatgtgtaggtttgctagatgggaatattgcgtgatgctgaggtatagggtac | 43470 |
| aattgatcccaatcaatggtggtaagcatagtgaccaccagctagtttttcagtcctcaccctactcact | 43540 |
| tcccattctagtagtccccctgtgctcccgtctttatttccgtgtttctcaagctcccactta | 43610 |
| taagtgagaacatgcagtatttggttttctgttttttatgttgactcacttaggataatggcctccagcag | 43680 |
| tatccatgtttctgcaagggacctgattttgttcttttcatggttgcatagtattccacagtgcatatg | 43750 |
| tggagaccacattttctttatttattccacccaccactgattggcatctaggttgattccatgtctgtct | 43820 |
| ttgctattgtgaatagtactacagtgaacatacaaatgcatgcgtcttttttgtagaacgatttattttc | 43890 |
| ctttgagtatatacccagtaacgggattgctgggtcaaatggtagttttgtttcatttaagtcctttgag | 43960 |
| aaatctccaaactactttccacagtggctgaactaatttacaatctcagcaagaatgtataagtgttccc | 44030 |
| ttttctctgcaaactcactggcatctgttatatatttttttttttgactatttaatgatggcctttctg | 44100 |
| actggtgtgagatggtttctcattgtggtttgatttacatttccctaatgatcaatgatgtggagcatt | 44170 |
| tttcagatgttattgattgcttatatgccctcttttgaagtgtgtgttcatgttctaggcacagttt | 44240 |
| tttttttgtttttgtttgttttgttttgtttgagacagagtctagctctgttgcccaggctgga | 44310 |
| gtgcagtagcaccatctcggctcactgcaacctctacctcctgggttcaaaaatcctgcctcagcctcc | 44380 |
| taagtaggtgggattacaggtgcccaccaccatgcctggctaattattttgtattttttagtagagaca | 44450 |
| gggtttcaccatgttggccaggctagtttgagctcctgacctcaagtgatctgctgcctcggcctcctg | 44520 |
| aagtgctaggattacaggcgtgagcgaccactaccagccccttggcacagttttttaatggggttatttgga | 44590 |
| aactcagtttttatgctaaggttcaactaactgtggacaacccagtagaaataggggttggacaaaaggg | 44660 |
| cctgatctaaagctaatggactgagtggggaaacccagccaggtctgtctgcctagattcttcttggcct | 44730 |
| ctctgagcagcattccttctgggtgtgaggtaggaccctctgtggaatgggggtcttaggacctacagt | 44800 |
| caaaaaggcaggtcagaggattttatttatggccagtgtttacagaaaggcagggaaagttgaggtcatc | 44870 |
| ttttttttggtttcatgggtgcttttgtggggaaggggtctggtttgtatgacctgcttagggaggaggga | 44940 |
| ttccagttcctatgccagccttcgggggagaatggaattgagagacaacaggtcaggggagggtcagaga | 45010 |
| aaaacctttgcctctgaggctgctgaagccttcattttgtggtatcattctctgagccccaacaacaca | 45080 |
| aatttttttaacttcatgcaaaactcttaggtcagttgagcctagaatacaggtttctacgctgtgtggc | 45150 |
| taaagtacggtccttccctcctctccacagggagcagatgaaatttattttggaggaagttaactcagaa | 45220 |
| tagaaggacccagagatgtcagagagtggagtggggcgaggcccagactccgtatctgtcctgagaaa | 45290 |
| gttaggacataaggacccacagacatcagagagtggagtagggggtgagggcccacgctctgtgtctgtaa | 45360 |
| gggaattgtctacactctgcatactcacagccatcagctttcttgttcttccttccaagttgaaagtcac | 45430 |
| tggactccttcaagtccatcctggaggatccctttcttggtaaactgaactggcagagaaaagtattcca | 45500 |
| taactggcatttggaggccatttgggcctattacttatttactgtacaaatatgttcacctgctgaggaag | 45570 |
| gaccccctggctatccacacagacctgattcttaagtgagaaaagacagtcttacatcctagatatttttg | 45640 |
| agaagctttcaataagaaattcttttttaaaaattgaaaaaagaatcatctggaggtagcacagacaacac | 45710 |
| caaccaagaaaacaagagacaaaatttctaatctgtaacttgtaggagatatgatgaaatagtgactcat | 45780 |
| aaaaaacatgggaattctattaaaatgtgacatattaggcaaattaaataatcagattggagaacgatta | 45850 |
| tgaggatatctccaatggacaaaactttaatgagagagagatagcaaaatggaaaggaacgaatatggag | 45920 |
| actctaggaatctgacattcgaagagtattttcaggaaggacaacagaatacaaaatacaaagtgact | 45990 |
| tatgaataattttttaaaataatcccagcattgagggatctacacttccaggcttatgaaacaacactcag | 46060 |
| ggctcaccatagtgaatgaattgaaactccaaactacaaaagcacattgcgagatttcagaagaacaaat | 46130 |
| atatagggaagatcctaagagcttggaggctgtattaggccgttcttgcattgatataaagaaatacccg | 46200 |
| agactgggtaatttacaaagaaaagaggtttaattggctcatggttctgcaggccgtacaggaagcatgg | 46270 |
| cggctcctgggggaggcctcaggaacgtgtcaatcatgacagaaggtgaagggaaagcaggcacatcttac | 46340 |
| atggctggagcacgaggaagagagagagaggacgtgctacagcctttcaaaccaccaggtctcctgagaa | 46410 |
| ctcactcactatacagtaccaaggggtgtgtacagtaccattcaagagaactctgctcccatgatgcca | 46480 |
| tcacctccaccaggccccatctccaacactggggattacaattcaatatgagatttgggcagggacaca | 46550 |
| gatccaaatcatatcagaggcaaagaaaaaaaacttattaagaatcaagaatttgtaatgtcatagaatg | 46620 |
| cttcatgtcttcactgaacgttaaaagatagaaactttcacaattctaagaaaaaacaatttactacgta | 46690 |
| gaactcttggagcaaactgtccatgggcaggcagggtcaaggcatttacactgatgtagcatttccgaaa | 46760 |
| atttacctttttgtgcacccttttcttggaaagctgtgtgattatgtcttccttcaaacagcggaataaatg | 46830 |
| acaaatagaaagatggggaatccaaggaacagtggccttcacagaagagagctgaaagaatgcaggtctc | 46900 |
| agattaatgcccagagcaggctgggacagctggaatcctagagtgagacttcaaggagaaagtacataaa | 46970 |
| agaaaaggaaatgagccatttgaccatgtagaaatagtacttgagatgggcttttagttcccttggaacat | 47040 |
| tcagaaaattgaacaatagacacacagaaaagcatgaaatgaaaatgtgaagttgttgttgtctccaga | 47110 |
| taaaacaggaggcaattcaatgaaggagatttaattagagtagaatgcttcattcaggagtgattattaa | 47180 |
| ttgcacagttacaataaagttaaagagagaaggccaggtgtagtggctcacgcctgtaatcccagcactc | 47250 |
| tgggaggccaagataggcagatctcttgagtccaacagttcgagaccagcctggccaatgctggcgaaatc | 47320 |
| ccacctctacaaaaaattcaaaaattatctgggcatggtggtgtggtggcctgtagtcccagttactgcaga | 47390 |
| ggctgaggtgggaagattgctggagcctggaaggttgggggctgcggtgagttgtgactgtaccattgcac | 47460 |
| tccagcctgggcaacagagcaagacccgtctcgaaaaacaaaaaggcagaagggcaaatagagtggt | 47530 |
| ggttgcccattgataatttataggtaatatctaaaataatatatcaagaaaaatagcataaactatta | 47600 |
| cttagaaatatcatagagcatatatttggagaggagaagctaagaaatctgaaagcatttgcttctaaa | 47670 |
| gcaagtgtggtcatgggatgttgtatgttgggcaagaaagtgctgtttgttgtgcaaataacacttgtag | 47740 |
| tagtttgacctttaaaaacttcatgcatgccttctcttttattgaaacaaaatttttttcaaaagaaaatgat | 47810 |
| aaggccaagattgaatggtatgtgaatgtgaatatgacagttaaaagcatgatttctcaaatgtacctgc | 47880 |
| ccattggaatcacctggagaatgtaataggtattaatgcctgtgctgtggcctccagagattctgacttt | 47950 |
| gctcggtctgcaatgcagactgggcagtgaaattttcaattctccttagggattctaagatgcagcaga | 48020 |
| gtttaggaagcatggatctaggtagctcagattcttacttgaatttaaaaatctctagctgggtgcagtg | 48090 |

FIGURE 8A-13

```
gctcatgcctgcaatcccagcactttgtgctgggctgaggtgggaggattgcttgagcccaagagttcca    48160
gaccagcctgggcaacatagcgtgcctgtgttcccagctattcaggagactgaggtggggaggttcgcttg    48230
agccctggaggtcaaggctgcagtgagctgagattataccgctgcactcaagcctgggcaacagagtgag    48300
accctgtttcaaaaaaaaaaaaatcttgtccagtgttctcttcaccaagatacagtggtttcagtaata    48370
aactactactaacatgatgatttagattgagccaacttcatcactcagtcatttctttgttatctgatat    48440
gttcttttatggaaaggctttaattgcttgaaaatgacctaatgcttctcccaagcttcccatttttttt    48510
cccttcttaactgaagtcacagaatgttctcgtgtgtggaatgctttgtctatcctacgggaagccaat    48580
tgtgcatggctcatggcgccatgctggcttaattgttccaattcctcctgtttctccgaccacacatgag    48650
gttgaattaaatataatttcctcagtttgcatttcccaggcagtcgtcctaagtggcttcttggaggagc    48720
tctgtgcattccactggtctaattctgtgatgccctttaactcgagggccaaggacataattaccagctc    48790
tagaaattcgttccgtggtcaaggatgcttgtgcagaggccaaattttctttcattataatttggccttt    48860
gccaagcttcaaagtgaaggggattgagttcctactaaagagtattggcacctaggaagtgaatgctttc    48930
tctatcttttgcagctagtgtgttctacattttcttcaatgtaccttctgcctggtaaatgtcagattatt    49000
tgttgatcatcctcagggtgtagttctttgtgttgttaaataagaacccagtggcttaaaagcattggct    49070
tttgagaagtcattttttatcctggatgataactcaaatccatgcagtgctgatatttacagctgggaggt    49140
gacatgatcttatcctttggtctgttgctcaaattattgatttcagtaggacttactggctcccttctgt    49210
cttggggatacctttgatctgtcttgccttgggggaccctccctctgacctggaatagcagcctatttcc    49280
acaagaagggaccctctgagagaggacagtcttcataccgcctcttccgattttcctttatcttttatgg    49350
gttttggctttataactttactcttagaatgtccttaaagctaatgatttttttaatgttctctagtgtat    49420
tactaaaagctcttcatctacttgaaagactggggcaggaagattgcttgagcccaaaaggtcgaggctg    49490
cagtgagttgtgatcctgccactgtattccagcctgggtgacagagcaagaccctgtctcaaaaaaataa    49560
aaaggacaggtgcagtggctcacgcctataatcccagcctttgggaggctgaagcaggaggattgcttg    49630
aagccagagttctagaccagcctgcaacatagagagaccccatctctcaaaaaataaaaaaaaatagct    49700
ggacatgatggcacaccctgtagtcccagcttcttgtggggctgagaccagcaggaggacttctagagc    49770
ctaggaattccaggatgcagtgagcaatatgtatgtgttaatacatagtgaaaccagttattggagaatt    49840
agtatatgtcctcccacaaattcagtatgtttcctaattatccaattaattcaaagggcataaacataa    49910
tagatgcaaattattttacgtttttttgtttaaaaacctttttgactgaatcagtctatgacgcttagta    49980
tttgaagttgcggacagaacttagtcttaagatagcactcgctttgttgatagatttccatggagggaat    50050
ttttgccagatgataatttagcttgaagatgttatagatgtggacagtcacaccctctaagttacacagt    50120
ctggggtgggccaattgaaaagaacatgcagaaacacaggcttgttaagggataattaaacgtgggggaa    50190
atagaacagtcatggcagaggatttaatagggtttaattgggttaggaagaataggccggagtgaaagaa    50260
tagctcttaataggaggtctagaaatagccaaggaagcattaattgcagaaaatctgtgacatctgatt    50330
actgtagtgaaagaaagatccacctttaaaaatcctatctatacagaaagaagtgataggagaaggaaa    50400
tcttcccacggacatatttaagaaaaacagtggggaggtttgagatttcaaagggccatggttcaggtta    50470
taattcaaagagaggcaaatgatagtcctactcttcttgagtttcaggaaggggggaggattttgccact    50540
tgctgtgaaataattttggagcttctataacgttgatcctttcatcctatttttcttggacttgggatg    50610
tggggagtggataagatggggatgggaagaagcaagtcattttgaaatgcctcttttgattctgttcattcc    50680
cggaattcttctccatgggccttaaagagtagagactcctcccggtgcatgacatccagtggccaatta    50750
atgaaactttatttcctcagataagttcccttcctccattaatttgtgggaattcagatgaaaacttact    50820
tggactgtggttttctatgtgtttgtgaatgaaggacatgtttgtctttgaccttcctttagtttcacg    50890
tcttagtcttgatatttaagtagctttggttcagacagagaaggaccatgtgtgcagttgctgggactgc    50960
tctctagcttggaggttccctggtcttgggaaagatctccctgccctatgcaggtggcataggctgtttaa    51030
ttttctacatgagagaagcgctagagtttttttattcattacttgtgtgcacagctgtggcctctaggga    51100
agctcagctgaggtggtctcaggttccaccaaaggttaccggggagagatgactaggaagacaggaagac    51170
ctgtctcacttggggagggtatggcaagagctaggcaagacctcctggtggagatatttgcctttattct    51240
ttcttttttttttttttttttttgagacagtttcactctgtcacccgggctgaagtgtagtggtgcga    51310
tcatggctcacaccaacctcccgtctcgagctcaagccatcctcccacctcagcctcttgagtagctag    51380
ggctacaggcatgcaacaccatgtccagctaattttttaaattatttttagaaacaaggttttgccatgt    51450
gcccagactggtcttgaactcttaggctcaagtgatcctcccgcctcagcctccgaaagtgttgggatta    51520
taggcatgagccatgttgcctgacccatttattctcaagtacttatgctcagggcaggtcttccaaggga    51590
agagaacagccagataagactcgtatgagatagctgaggaggtggcatttcatccttccatgcacatgct    51660
ccttatccacaagcagaaatgctgtaacctttgctgtccccactaggtcataggtagatacgcaggtg    51730
atgaccacagactggcaattagccaaggattctcagctgtgcacgctacatgtgtgagtgtgtgtgacag    51800
atccctttggcggtttggtggaaaattgatacattttgtaaaaatgatatgtttaagtcatacaataagg    51870
taaataacgcataaaaggaaatcggttttattgaaatagttaccaaggtatattaatattaatatttaaa    51940
gttggtgcagtggctcatgcctgtaaaccagcatttggggaggctgaggtgagaggattgcttgaggc    52010
caggagttcaagaccagcctggccaacaaagtgagactctgtttctacaatcaataaaataaaaataaa    52080
aataaaaagatatatttaaactgggctacagtaatacatgtggcatctttattgtgtgctaagtacctga    52150
tctacttaagagggttcgtaatagtcacaatttcaaagtacaataagcgtaaacagtattttgggatatct    52220
gtgataacagtgttaagtgtcctacctacacgggtaatggaagcaaatactaaatttcagtgcatggtag    52290
tgaaactaaagatgtaattacttttgcccattgcaatttgtagaacccatggaatctatctaaagactcc    52360
tgggtggcaaaggataaatgcttgagggtatgataccccattcttcatgatgttgattattacatattgca    52430
tgcctgtatcaaaacaactcatgtgccccatatatatatatatgtatgtatatacacctgctatgtac    52500
tcacaaaaaataaatgaagacacctggggtgggattggggttttttggacttagggtggagaacatctgca    52570
tttagaattgtgtagaggaaaggttttgatttatttattataccttgttttcttaaaaacctgcatg    52640
tgtagtaggaattttgccagaggtgggaatgtgagagtcactagtttgcagcatagagcattctatactg    52710
agataattattttttatgtcaaaagaaagtgaagaatctggcagattagaatcttcatgttattttcatt    52780
taaaaagcttgaagtgtcaatatcaattaatattgactgctatttactgacattttggcaaaaaacat    52850
ttcattttaatgaattttgtcttgtttgaatgtttgtaaggctttggaggtagttttaggagatagttgc    52920
ctttgattcctgaggtatattcttgggtctaccctgattctgtctcttgactttgcacctctttccttcc    52990
tgaaccctgtttaaaagagccttcctttttacgactcttttcttccatcctattcttccttcccatgctaa    53060
tgtgagacacagaggttttatgagaagcctgttgtctatatgctggatcttggaagccttggttatttc    53130
ctagagatggaaggtctgatctcagttaagttctgaccccaggacaagaagcctctctggagtaactgac    53200
```

FIGURE 8A-14

```
tcactgggatagagcctgttttcacaaattaatattcctgtctggggagggcagaggaaacattttgggg      53270
agtgggtggaggtgatgaggttcaagcctgaggatgaagcttgcctttcctgggagcttgtacagtgca      53340
tactcaggaaataaactgtgtgggaaaggtggtgtttagtaatctagagccgaacaccttgtaaggccct     53410
caccttgtcattctgcactgtcagaagcacatgagaaagagtgtaggctgccagagcaagcatcacacc     53480
gaaataggaacttctcagatagagccgtctgcctaaaacaaagtaaccttagcaaataggatctgtgcta    53550
cagaaaatggagcactctagccaggggtgtgagatggagctggtcctggggtcacaggtggtgtcttggg    53620
aaacgttctgaagacactcagcttttcggatattgcacagttcattaggagaggtatgggcagtggttat    53690
gaagctcctatgtaagagacatagagatacactcaacagtattactccagagggttctggctcctgtct    53760
tgcacttgggagtacacacttgttcttgtccacattaacctccaactgtccacatgatcaaccatctgca   53830
gacccactgccagttgagggtcgtgccaggtcagaagtactaactgcaggttaaactgtgctatttagaa   53900
attgagtgttttttttcttactcaaactgacagttttcctttgtagaagaactcactcagcttccactctg  53970
gcttaaatatttcctttacatgatcaatattatctctgtccatcagatacagcaatgagaaagccttta    54040
aaggaaatgaggttaaaagtgactgggtatctagaattctttattttgtttgctaaattgcaggcaaata   54110
tattcccagaactagttgtgatacctttcagaaactggcttatttgacattggctgaaagtaatactct   54180
aacactttactgctgtgtcaatgagtgaaattcctgcaggcaaaaacaataggagctacatcgtgaagcc    54250
tatgagaattttatggtggaaacatgagtggagcaggtggtggaagtagctcatcttctgtggttgtggt    54320
acccacaggagatgagctaaggagaatgccctgaaacctaaccttgccaattttctgtcttctgtgtcct   54390
ggttccttctggtttccttgtgtctcttttcttcctttaatttaatagtgtttactgaagaccttctgt    54460
cttccaagttcaagtattagtcatctctgggctttgcccttagatacttatcatagtctagcaatgaatg   54530
taagcattgaggaagtaatggtgacataatgtgaatgttcagtgtggtatcatcttcccccactctttgta  54600
aatcttggtggtcttaattcttgaatgtcaatgcttaccccctctatgctgtctttacagaagtcctctg   54670
gcctagctctctctcacatgtctaaaattgtagaagcatcttctgaggcatccattgcaaagtccattctg  54740
cagaagcccaccatcccacagaaggagcaggtgggaggcagtggaccacaggctggctgcatggtagcaa   54810
ttgaaaagcaatggagcacaggctggcttcatggtaacagttgaaaagcaatggagcacaggctggctta  54880
attgtagcaattgaaaggcaagcttcatctcatcagctggagtgtttactacttgaggatgggtacttga   54950
ttggtgtatctttacattttatcaaaatgggtttcaccttggaagcattcagtggtacctcagtgaataa   55020
ttgtaattagctaggatttctttggggaatacttattgttctaaatttatatgtgttttacatatatgtac  55090
tgtattagtctttttttcacactgctgataaagacataccggagactgggtaatttataaagaaaaagaga  55160
tttaatggactcacagttccatgtggttggggaggcttcacaattatggcaaaaggcaaggtaagaacaa   55230
aggcatgtcttacatggcggaaggcaaaaagagagagcttgttcagggggaactcctcattataaaaccat  55300
cagatctcatgagacttactatcacgagaacagtatgggggaaactgccctcttgattcagttatctccc   55370
acagggtccctctccctatacgtgggaattatgggagctacaattcaagatgagatttgtgtgggacac    55440
agtcaaaccatatcacatacatatggcatatctttatgtaaggtgtgtgaataggtgtgtatattcata    55510
tactcttgtactttctcaaacacaaaccatagcacgtgcaataatatccttgagttacatctgctactct   55580
gcccattttacacataagagatggaagcattgatggttatattaggtagggttctctagaggaacagaac   55650
taataggacagatagatatataaaggggagtttatcaagtagtatttgttcacacgatcacaaggtccca   55720
caacaggccatctgcaagctgaggagcaaggaagccagtccgaatcccaaagctgaaggacttggagtct   55790
gatgtttgagggcaggaagcatctagcacaggagaaagatgtagacttagaggctaagctagtctagtct  55860
tttcatgttttttctgtctctgcttttatatttgctggcagctgattagatggtgcccacccagattaaggg 55930
tgggtctgccttccccagccctctgactcaaatattaatctcctttggcaacaccctcagagacacaccc   56000
aggatcaatactttgcattcttcaatccaatgaagttgacactcagcattaaccatcacaatggtgtata   56070
caccctctctggttgctgatggagttaaagtgagagcaccaggatttgaatcatagtcataaaaactgcaca 56140
aaacctctgccccatactacctcccagatacataatacacacatgagtaggtgttttttgtgcctgttata  56210
gtgcatttgagcctgttgttcttagtttgctcttatgtaggaccatctctctgaaaacagatgatcagca   56280
tcatatgcaacaggtagtattgattatctgtagcataaaggcatggaacacgggattttcagggaatgga   56350
gtaggaaaaattcctgaacctaagcagcttaatagtttaatatttcacttggttagttcgaatatatatg   56420
ttcatatgcacatgcatgaaatgacatggataaaataagttttaatgtattgtatctatataaatctctt  56490
taaacctcaaaaaatgtatatatccaaactaattatttgtcagtctctccctctctttctccctctctct   56560
cttttccacgtatttatatataaatatttctgcaaactaaccaactgaaatattaagctcctatctatgtt  56630
ttatatgtatttctgcaaatagccaaccaaaatattaaagcaattaaactcctaaatataatatttcttt  56700
tatctattatattcttcaaactaaccaattgaaatattaagcttctatgttttatatataaagt         56770
atttctccaaataaccaagcaaaatattgaggtattaagctcctgtgaatgttttatattattctatgta   56840
tatagaataatatattttatatgttttttattatatttttatattattctatatgtagaataatatatttt  56910
atatcctatattatatatagaataatatattttatatcctatattatatatagaataatatattatatat   56980
cctatattatatatagaataatatattttatatcctatattatatatagaataatatattttatatccta   57050
tataatataatattttatatcctatataatatatagaataatatattttatatcctatataatatata     57120
atatatagaataatatattttatatcctataatatatagaataatatattttatatcctatataatat     57190
atagaataatatattttatatcctataatatatagaataatatattttatatcctatattatatatag     57260
aataatatattttatatcctatattatatatagaataatatattttatatcctatattatatatagaata   57330
atatattttatatcctatattatatatagaataatatattttatttttataatatattt              57400
tgtaatatatatgtttttatatatagaataatatattctctctctatatatagcaggtt               57470
agtttgaagatatctatacgtataatatattaaaatttattttttggccaggcgcgttggctcacgcctgt   57540
aatcccagcactctgggaggccaaggcgggcggataatgaggtcaggagttcaagactagcctggccaat   57610
atggtgaaaccctgtctctactaaaaatacaaaaaattagctgggcatgggggcatatgcttgtagtcct   57680
ggctactcaggaggctgaggcaagataatccgggaggcagaagttgtagtgagccgagatctcaccactg   57750
cactccagcctgggtgacagagtgaaactctgtctcaaaaaaaaaaaaaatttttttatagatataattt   57820
catatatgataagttaaagtacaaactcttgaaacaactcctcttatatgaggggaaagaagaagatt     57890
atttgtacagtacaattagtacagtgaattctgggaaaaagtcagtaaatactcatttcaaatcctcatg   57960
tacaattcaagtaaagaaaaatctggtggcatttttatatcctgctaataaaggttatctggtgttggaa   58030
aacatatttatttttacatgtacatagtaggtgtatatatttgtgggtacatgagatattttgatatag    58100
gcatatgtgtaaaaatcacattagaagtatacaataatggagtatacatcacctgaagcatttatcattctttgtg 58170
ttacagactttccaattatgcttttagttttattaaaatatacagtaaattaatgttgactgcagtcacc   58240
ctgttgtgctatcaaataccagatcttattcattctgtctatattttgtgcccattaaccatcctcact   58310
```

FIGURE 8A-15

```
tctctctctctcccattacccttcccagcctctggtagccatcattctactctctgtctccctgactgca    58380
actgaaagaaatattttaaagaataggctggaaggccacactgactctcactgtttctggcacactaaa    58450
ccttgccatttctgcagtaggggattgtctcgcttcagttatgccttgctacttcagtgaaggactttct   58520
gttcccactgggctcctatactgagtctgcttggagataatagtctgagatgtcagagcgtcttagtgg    58590
tgaaagcaacttaagagggtcactggcacaagccctcgttttgcagtggagggagttgatggcgagggcac  58660
ttggctaattagtgaccaggggctatagcaggctcaggttccatgactgtgcttaccatggctggcaggat  58730
cccagggcttttctgtgtaatatgtgggtggatggtctattgccttgggcttgtcgcataatcatggaga  58800
aaacagtttatatttttcccttcaattttttaaatccaagatagtttgatagcacatgggaaaataaagtca 58870
ttgagtaaaaacttatacggatgagaatcttttgattaaattttcattgtaaaataatcatagtcataaaa  58940
agtgtatcaaaatgtgtatttggatattcattttaaagagtaaaaaataatcagatacatagtattgtac   59010
ccactgacagacaaggaaagagaacattcccactgtttttatatatcagtgtgagttgcttccctctctc   59080
ctacctttcagtgaaatctaatcccccaagatttggttttcatactgtccttgctgtatatttcaggaca   59150
aacatagctctgagcaatatattgtttagttttactattatgtaaataaaatcacactatttgtagtctt   59220
ctgtgacttgccttttatgtttgagattttcccattttcctccatatatctgtattttattcattttga    59290
ctgttttgtaaagccttctgttttaatatgccaacatttatttattcattatcctatttatggatatctg   59360
gattgtggcaatatttttgcaattataattggggcttattatcctcagcaaactaacgcaggaacaga    59430
aaaccaaacaccgcatgttctcactcataagtgggagctgaatgatgagaacacatggacacatggggga   59500
gggaaacaacacacagttgggcctgtctggggatgcccggaggggagagcatcaggaagactagctaata   59570
gatgctgggcttaatacataggtgatgggttgatttgtgcagcaaaccaccatggcacatgtttacctat   59640
gtcacaaacctgcacatcctgcacatgtaccttggaacttaaaagttgaagaaaaaaaaatgggggctgca  59710
gtggacatttccgtgcatgtttcctgatgcatgggagttctagttgctccacatcgttgctcagtacttg   59780
gtatcattgtttgtttgtatttttattaatcctattgtgatttcatctgcatttcaccaataatgaatga   59850
cattgagcctcttgtcctatgttgaggctatctgtagatttgaggactccttcctggatgtggatttatg   59920
gtgggagaaaccaacaaagatggctttgagtgtaggctgaattactagaaaagtaatgatctagttatcca  59990
aatatgaaacaaaagcatggaagcagtttgggggattggagaatgagatttttaggagcaccataagatgt  60060
ctatctgactatattcttgaagagaaaatagtcatggcactacaggcatggtggcacataccatgttatc   60130
agctggcactacaggtgtatgcctccatgaccttgaggacatatgactttgagttcggtgagagagatga   60200
acacaaagcctagagagatctgcaaatcatttgatttagatttagaaattgtctttaaagatgtctgggaa 60270
aaacatttaat ttcacacagaaaatcaagcattaacgcacttttattattgccagtccttgtgctagctttagatatgca 60340
gaagatgaataagaagaaaaaatgcatcacaggtagggatagataccttcatgagaatgtaagctcctag   60410
tgggcaggaactccttctttaccccattacgtacccttacctagcatagtgatctttacgggatacttct   60480
gtggtctgaaggcttgtgtctttccagaatcccccatgttgacgttgtaaccccaaagtgatggtgctagg  60550
aggtagggcctttggagctggctgatgagatcatgagggtggcccccagaatggtattaatgacattttaaa 60620
agatacccccaggggagattccttgccctttttccccttttccaaagttataaggaaaatacagccctctagg 60690
aagcaggccctcaccatacactgaatctaccatgccttgatcttggacttccagcctccagagctgtgag   60760
caatgaatatctgtggtttataagccccccaagctatgatattttgttacagcagcctgaatggactaag   60830
ccaacttctaagttttggtgttgtcttattctttggtcggtgtaggatcttctgtccacatagtttac    60900
tctagaaagatgtatgccctattcctcatggtatatttgtctttcctatctgtggaatatcctcttatcc   60970
aattcgtcttggctgggcaacatataagccattaactctttacccttgggtttagtttgggttctgctga   61040
ggcccctgctgaaaattctggtttctacaattatggctcatgcatgttcctgacccattaaacttcagtg   61110
gaagaacagaaatggtgagggaggtgatggagttgataccttgagctgccatatggtgcaagatcatctt   61180
gaagatagaacatttggcatccttttttttttttaagagatggggtcttgctaatttgcccaggctaaact  61250
caaactcctgggctcaagtgatgctcctggctcagcctcccaattacctggcaatacaggcatgtgccac   61320
catgcctggccacattttactctccaattgcttaatatatagtaaagataatggttcaaaatggtaaat   61390
ttttttttgtgtgtataccaataacattttttttaccttaaacatattcaatctttatttgacaatttt   61460
taaaatttcaacttttttttttattcatgggatatatctgcaggatttttttacctgggtgtattggatg   61530
gtgctgagggtttgaggtacagttgattctgccacacaggtatggagtatagcacccaacaggtagttttt   61600
ctacctttccccctccctctccctgctgtagtactccccaagtttgttattgcttttatgtccatgagtac 61670
ccaatgtttagctcccacttctaagtgagaacatgtggtatttgattttctgtttctgcattaattaact   61740
taaaataatggcttccagctgcatccatgttgctgcaaaggacatgatttcatttgtttttttttgtttg   61810
tttgtttgtttttttgagacggagtctcgctctgttgcccaggctggagtgcagtggcgcgatcttggc    61880
tcactgcaagctccgcctcctgggttcacgctattctcctgcctcagcctcctgagtagctgggactaca   61950
ggtgccgccaccacgcccagctaattttttgtattttttagtagagatgggggtttcactgttagccag    62020
gatggtctcgatctcctgacctcgtgatccacctgcctcggcctcccaaagtgctgggattacaggcgtg    62090
agccaccgcgccggctgatttgttttatggctgcatagtattccgtggtatatacgcatcacattttct    62160
ttattcaatctactgttgatggactcttagattgattccatgtctttgctattgtgaatagtgctgtgat   62230
gagcatacatgtgcatgtgtcttttttggtagaacaattatttttcctttgtatatataccccagtaatgtg 62300
attgctaggtcaaatggtagttcctcttttaagttccttgagaaatctccatactgctttacacaatggc   62370
tgaactaattgacgttctcaccaacggtgtatatagccttctcttttctctgcagccgcaacagcatctg   62440
ttgttttttgatgtttatgaatagccattctgactagtgtgagatggtatctcattgtggttttgactt    62510
gcatttctctggtgaaaatggtggatttttaaatgggatttcattttagattataataaaactgcata     62580
ggtgactgtgcaaagaactcttaagatttgacaaaaggcaaattagattgtaatctcctttatgtaggag   62650
gggaaataaaaaccagaatattaaaatctacatgtacaaaaatagacaaagtggcagattgctggtgt     62720
tggatggatgttgagcagggatggaggacttgtgtgtgcatgcatgcatggccatgcgtggagagtggtc    62790
attcatttggtaacagcatagagctttgggcttcagaacaaaagataagccacatcccactcaggtacc   62860
ctaaaatgttgtctccactagacacaaagaaaaggaagccagagatgtctgtagcttatgcacagtttt    62930
gggaatagctattctagacttttcttagtgaacagtatagaaggattattgtacaagcccagtaattggg   63000
caaggatcagattctgttgcttttctggatgctccgtaatgaatgtgagatggaagcggatgtct       63070
caagtgcttcttgttctcagaaacctcctggcagcagacatctcagtgggcccagacgttcagcgtggct   63140
ggaagtaaaacacagggaagggtgctctttctcagttatcctatttttttttaaaagcatctacaaagct   63210
tcctgttttctaatatattcccaggcctttgaaagacaaggccataaacacccaggagatgtgacttat    63280
tcttttttaaggtccagataccaaaatgcctgtcatcagggctcaccttaattaaatacgtatcttaaaat 63350
taaaccaatctcaatttaaggaatgtatactttggggagaaattttattacaattttttattcagaacactt 63420
```

FIGURE 8A-16

```
taaattctgataggcctgaagagtgtgagcctcaccttaattgcaacctgagtcagaataactgccctgc      63490
agagaatcatttaaaatacccaatcaagttataaattagtcaaaatgccattctgagatattattatttt      63560
atgcagtctttgcagagaatacatgctatatagcccttcttcactcccaaagtatatgtatatatttaat      63630
gaagttttcaccttttttattaaaatttttaatccattaacaattttagaattcattttgtagcatatcc      63700
tctttatcttagagatattaaatatctacctatttatgaataactatcaataaccacgtttcaccctttg      63770
tgaaatcctttcagttttttgaaactcacatgggagatcttgttttttttttcccacaaggatgtagg       63840
ttggttaaatttacagtggttcttaatgatgataatgcacatttgattgatatcaataataaatattga      63910
tatcttcaatatcaacatttcttgtaatgctaaaaatttacaagttgccaattttttgaatatgactata      63980
ttttcacacacacacacatacacgacagcactaattatattcactaaatatacctacagatacttaatca      64050
tttacacagccactataattttatacttgatgccttaaaccagtaattctcccttgagggtggttttggc      64120
ccctgggctacctagcactatctagagacattttccatagttaaaactgggtaggaggtgccactatcat      64190
ctagtgagtagaggtcaggggatgctgcaaaatactgtacattgtacaggcgacgcccccacaacaaagaa    64260
ttatatggttcacaatgtcatttatactgagatggggaaacgctgggctttaattatagcaattttgtgc    64330
aaattagccaaatttcaaaaaacaagggagtgaaaaaagatagctctcaacctgtgaatattgtgaatgc    64400
ccaatctagacctagtaagtgtacagatgcccttgggcgcgtcttcttaggttgctgctgcttcataatc    64470
gctcactgcccatcaggaccttgtgggatgtagatttaggcagaggagggttttgatcatacagctggat    64540
cagtcataaccaataagtgactcatagtctcattcacattgagtttgagaatttaaggtgtgggctggaa    64610
ttccttatggaactaactttatataccttggaagaagtccacccactgaattctacattttttgagctct    64680
gtgtttcagggaatgtgcaatacccttgaggatacatactatctcatttagtcccaagtagcttttaaata   64750
tttgagagtggttttggcccccaggctgaaagtaacagctacctctggttaaaaatctttcaggaaagaa    64820
gcaaccaaacaggacatcacctctttgtttttcttgtctgtctcttaattattcagaaatgggattgctg    64890
tatggcagacatccaaatgttgtctacagtagaattcagagatagaagcaaacacctaaatcagtcattg    64960
gtgagatgctatttgtcacttttcaaagttataatccagattttcaagtgcgttttcatccaactctggtga   65030
actttttcccaggatgtcatgtactatggaatttccccccattgtattattgttctgtgatagatccagct   65100
ccaatatgtttatttaaaaaaaaaaaagccatgtgatgtattctgttcaactgattacttaaatgaaatg    65170
gataattattttctgatgcagatgctctgaataacccacaaaatccttagaaacacatttgtatattttg    65240
agttgaagaacatgctaaaggcaccctccttgcaacaccagtgaaatattttctgttcctaggggatca     65310
tttaacaacataattgtccattcctgcacagcattcttttattgtcacaggagcagcgacttatgtaggga   65380
tagttatattatctatgtaaagacaaattgaggtggtgacccttttaaaagttgactccaggctcaatggg   65450
aaagtaactcaaatgcagcctcagcttttaaatgggctgaagggtgaagaggatacccctcaaggcatg     65520
cagtggcttactggaaagtcaggataattgtatcaacacttttaattatgaatgaagtcttcaagaaact    65590
agcactacagcatgtacttgaaatgcaccatcttgtatagtgttttacaaggaaactgagattcagagca    65660
gtgaagtgtgtagcctaaatatatatgcacttgaccagaccaaggagaattttgtgtccaaagtctacact   65730
ctttttcatttgatgatgttcccttgtggcctgataaatatccacatcatgatgccagattgacttggat    65800
gcatgcttccatctttctcctactggaaaactttttagagctccatgcatgtctccttaggaaaatgtgac   65870
aatttccttaaacatttgagaaacagtgttttggaagtacccatgtattgataaccagtctggtaaacaa    65940
tagcaaaactgggaggtgttgttactataatctgcataacctgtataacttgaacatctgtttgatca      66010
ttcaacacagatttgtttagtgttttctaaatgtcaggcattgttcatggtgataggatgtacagaggaa    66080
ttaagacaagtggtggctgctaggcatggtgactcatgcctgtaatcccaacactttgaaaggtcgaggg    66150
gtaggatcccttgaggccagcctggacaacatagggtgacccaatgtctacaaaaaaatccaacgaatta    66220
gccggacatagtggtgcatgcttgtggtcccagctactcgggagggtgaggcgggaggatgggttgagcc    66290
caggagttggaggctgcagtgagctatgacagcaccactgcactgcagcttgggcaatatagcaagacac    66360
catctctaaaaaaaaacaaaataaataaagacaggtgatgttcttgctgttgcctactatgtggagatggc    66430
actatacacatttctatacaaatgaataggaatttcatagagagatgttgtgatttcgtggaagagcca     66500
gccagtgttctaggtggtcgttgtgtggcttcattattcttgtctgctttcttcctcttttaggctgcct    66570
tggagttttcataagaaattgtccctggaggtgttggatgatcacagcttccttggagcattgcagttgc    66640
tggaatccagtttcaggattaaggggagggctgcctccttgcaaggggctgccaagaaaaacggctgtgctt   66710
gttcttaacctcaggctctgtctgtgatcagtctgagagtctctcccaggtctactgctccctggaaagc    66780
cctatctctctgcaggctcgcctctgggctttgtctccttggagccacatcactgggacagctgtggatg    66850
tggatgcagatttgaaccATGTCACGCCCCAGGGACTGCTATGGCTTCCTTTGTTGTTCACCCCGGTCT      66920
GCGTCATGTTAAACTCCAATGTCCTCCTGTGGTTAACTGCTCTTGCCATCAAGTTCACCCTCATTGACAG     66990
CCAAGCACAGTATCCAGTTGTCAACACAAATTATGGCAAAATCCGGGGCCTAAGAACACCGTTACCCAAT     67060
GAGATCTTGGGTCCAGTGGAGCAGTACTTAGGGGTCCCCTATGCCTCACCCCCCACTGGAGAGAGGCGGT     67130
TTCAGCCCCCAGAACCCCCGTCCTCCTGGACTGGCATCCGAAATACTACTCAGTTTGCTGCTGTGTGCCC     67200
CCAGCACCTGGATGAGAGATCCTTACTGCATGACATGCTGCCCATCTGGTTTACCGCCAATTTGGATACT     67270
TTGATGACCTATGTTCAAGATCAAAATGAAGACTGCCTTTACTTAAACATCTACGTGCCCACGgaagatg     67340
gtgagtacctcactggaacagaaaacataccctctgtgcagtgttgagagagatttgctaggagggtttt     67410
tataatgtctcatgcatgatctcttctataacccgtttatttattttaattttttttcatattccaaa      67480
tgcaatccttgcagcaacttaccacatgttccacttgtatgtattggccatctactgactggacaaaac     67550
tataaataataactttaattattttcatatattgccttcttaactttttataatgcttatttgcagatga    67620
aaataaatatgagcatataatgttgcatgttatacctgaatcatctgtaaaggaatgaatctatagaaaa    67690
ataatagaattaagtacactattatgctccagtttgcaaactgaaagatagaaaaatggttctttctgc     67760
cttaatgacttaagatattagcacctttttgagttttcaaagaaaaacttgattgttttaatatacaa      67830
gtaggggatagttcatacaatggttggatttcattgtttagaatcggttttcttaacgtaaatttggatg    67900
ttcttttcttccaatattcgctgcaatcaagtggcaaaatgtaatcagatgattctagctacattagaga    67970
tgaatgcgtttgtattttaaaaatttccttttttatataaaacaacaatgaaagtctgtagacacaata     68040
acgtttaatatattaacctaatgttagtaaaacatgaatagttttatgtctgtatagattcaaattcag     68110
atttccttggaagaataaccagactaaagtatgccataatggtatcacatttcccagttagcatttccat    68180
atgccgttttagatgaggagaaagaacaacagagaataaaatatacctggaaagaaaggaagttaatt      68250
gtgggaatgatagatgtatctaatgtagaaactagagtgtgtcctttgtataaagttcttcgtgaaagt     68320
gtgataaatttctttatgtgagaaattttcttcttcttcctttttttttttttttaaacttcaatccctga    68390
aaacattttttcagtaagatttggctgaaaatagtaaatcaacaacgacgttaatccactgatctccaaa    68460
ttgtttgcatctatcagattactctttctccatataaatgccagatagtttaagtagagtgtcatgaaa     68530
```

FIGURE 8A-17

```
aaccataccagggttgtgtgtcactgaggttacaaattgtcattgagattacaaagaacagcccagagaa    68600
agaaatttaaaggattctgcttcattatattagtggtttctggcatattgcccttgtcgttatggtgacag    68670
acctctcaattatctcataaagtccaggtctgaatgtgattcaaggagttaaactgacatttggacgctg    68740
tacttccatggggtgttctgagctgtctccgtgcctaacagtccctctttgtgtgtgtgtgtgagatgaa    68810
taagagctctcaaaagcaattagggtctcatttgagcagccacctggttgagatctttctcataatga       68880
actattcaaacaaaaaccaaaaagaaaggaagacaaaaatggggagaaaaccccccaaacaggacaaagg    68950
gttaaaattgctttcataatactttggatgtgctagagtctggtgattttgtagagctagccttggcaac    69020
aatgaatcgcacttcaaatagaaggcctcctcatataggagttggacagaatgagaccacccatgaaaag    69090
aatcaatagcctccctgactgcagagcctgtatgtacaattgtgtggatggagaccacaaacggtgtgg      69160
ccgtttcattgcaattcggtattgaattaaaatttgaggaatgtaaatatgtgaaaaatgctattcagtg    69230
aaaaagtaatccaaacttcataataaacccagttccacttgtttagatctttaggcttttgaagcaata     69300
tgtgcatatgatcttgacaagggaatcagaaatctaatagtgactgaaaaggtagaatcgatctccccac    69370
gatgtgtaaactttagaattttgctggtggagagttcaaagctacagccctgcatgtttgtaccatccaca  69440
agtcacagcctattgggttaggagttttattttggttgcttgcttgtttttcttaactctatcaacgaa     69510
gaaccagtgcaggccaggcgcggtggctcacgcctgtaatcccagtactttgggaggccgaggcaggcag    69580
atcacgtggttaggagatcgagaccatcctggccaacatggtgaaaccccatctctactaaaaatacaaa    69650
aattagctgggcatggtggcgcgtgtctgtaatcccagctactcaggaggctgaggcaggagaattgctt    69720
gaaccaaggaggtggaggttgcagtgagccacaatcgcgccattgcactccagcctggcaacatagcaag    69790
actccgtctcaaaaaaaaacaaaaacaaaaaaagaaccaatgcagagctttagatgtttaattattaatt    69860
attcactaaatgaatgaactccgcatccacaacatattgaaatgttggcatcatgctgattctctccaaa    69930
ggccttctcttagggagtatctcagttcagatcaatgcttttatttagcaggagagagagcaatattatt    70000
atttggaattcaaaattccactctgaccagtctgacaaagccagaaagacaaatctaaacaataacaaca    70070
gcaaaaatctacttttttttgtttagcttttgtctttctgccttgatcagattggctcaaattttctatgttt  70140
ctactttcataaaatgtgtaggtatattaaaaatacaaaaatagactattttagatacgtacttatcctt     70210
acatttaagaactaacttgcatgaggaaaagtgttggaaatttcttcgtagtacaatagtttatgaaaca    70280
tatattttttttctgtagaaaacaatacttttataattcccttaaaataaatcaggtcttgctgaagg       70350
tgagtcttttcatttaaactggcatcatgatctactaaacttaggcttgggtcttttataactatttccta   70420
ccttacaaattctttatttaaaattttcataggttattaatttctctttgttgttagacaacaggctaat    70490
taattaacttgaattgcatatttaaccttttgataggtgctcaaataaggtcaaagtcagtcaagccagt    70560
cggaagctctagtaggacacgtgggccattgttgacaaggaacagttggagaccgattgaccgaatctgc    70630
atggtgtgtgtgtgtgtgtatgtgacagagagagagagagagagatagcagagagagtgtgactga       70700
gtgactactttgaggaagcaatgcagaatatggcttggtagcttgattaaacataaattgtgaaagtcaa    70770
gccgagaagttccagtctcacatactaagtccacttgagttcatacatgacggggatggcagtacagttcg   70840
tgattcgtcttggtcccaaggagactgaacacagaaagatgagttatggaaacacttaaggtttttaat      70910
gagaaccagtgatactgtttagaagtgaggttaaaaagtaagggaaaataaaagacacattttgaagga     70980
gttgctcagacaagatatcatattaaatataaagcttggaggagaaagagccacaagtgagtccagattg    71050
ccttgggaaatggacagacccatgaaccacttcctgagtgacctcacacctgtgcttttctcttggatcc     71120
ttggacatacatcttaaggtcttattcttgaaagatttcagggggcgagaagcccttccattcttcatcat    71190
gggactaaaaatactgggaaatataaaggaaaatataaatgaaagtcattatcgcccaggcacagtggct    71260
catgcctctaatcccagcactttgggaggtcatggtgggtggatcacttgaggtcaggaattcgtgacca    71330
gcctggccaatatggtgaaacccgtctttactacaaatacaaaaaattagctgggcatggtggtgtgcg     71400
cctgtaatctcagctactaggaggctgaggcaggagaatgacctgaactcgagaggtggagggaggttg     71470
cagtgagccgagatcgcaccactgcactccagcctgggcaacagagtgagaatccctctcaaaacaaaac   71540
aaagcaccactcattatcattgtattttcattgtagcataacagcaaatgccattatgatttctagaaaa    71610
gtgaaatttttgggtgtttttttttttgctagcaataacaattcaaaaggaagatatttaaaaaagaaca    71680
gattattggatgcaaggtgtccctatcatctttttcccccaagatgacacctgactctttgaatactatg    71750
acttaagtaagcttgctatgattgttgattgaggaccttttggtgaaaacatggagcttatgatgaaa       71820
tataaacagacacgacatggacaatgacctgtaggagtttgcacagttaataaacctagaggtagataat    71890
aagccagagcatcctagttagggaacaaagaaagctctgacagtcagggacaggctattttttgagg       71960
aaaaacttgatggaagctgttaagttgttgagctgtgccatgaagaatatatgggtgatggaagggattc    72030
atctattaaagcatctgatgaatggaacatttgaacacagaaatctatgttaagcagtttggtgtcaatc    72100
gttgctgttgttactacttgggtgttaagtgtggcgtggtaacagaagctgtgcttttagcatgggctgtt    72170
tctggcagtgccatatcatgaaagttctttttttttttttttttagaaaacaggatcttgctctgt         72240
catccagggtgaagtacaatggtgcactcatagctccctgcagcctcaacctcctgggctcaagggatcc    72310
ttccatctcagcttcctgagtagctgggactacaggtgcactccaccatacctggctaatctttttagtt    72380
tctgtagagatggggtgtcactatgttgctctggctggtcttgggttcaagtgatcctcccacctcggcc    72450
tcccaaaatgctggcattaccagcataagccattgcactgggcccataaactttttatgttatccacag     72520
ctgctgaccctatacttctctagggtagacaagctacctaagatgaaagcgtggcaggagaacaacaggga   72590
aagaagctggaaagtcaaccagctttgctagcgattttacaaaaaaaaatgtattcgcttcttttatag     72660
ataccactggatctaattcaagatataatttatagcatggttttcatccttgaatagctcccatcttttc    72730
tgagggtcttacaaacttttctggcattctgcattagtcaagagatatttgtgttcaaatggtagaaggc    72800
aacctagcctcaatcgactttgagggaaaaatggaaatttattagaagggctatgggatatccaaact       72870
tactgtaaaagttgagaaatcagattggcagaatggcgactagacttagacacacctggaa              72940
gcattgaatccaaggacatcaccaatcttcatatctcgttctttgcttctttctggaaataggcttgctt    73010
taaatggcagtaagagggttctctgcagttttttgttagttgcattttgttttttctcagtaccaccagtga  73080
gggacaaagttccataattccatactaaaaatcccagggcggggttttgattggcccacttgactcagga    73150
gtaagaagagataaaactggctgttcttgtgtataccagttggcaggggagaaggacagttctcacca       73220
taaggtgtctggaatgagcaggcactacttcacttcactgtccaaaatattttgagcatcgattatg        73290
ccagacatgccttagaggctgagattgtgagagatacaagcattcctaattttgagagataggtacttgt    73360
aggcagaaaagtcatggtccctgagagatgtgcaagcaccgccctccaccccctacccccagccaactcg    73430
cccattcctggaacctgggaataggttggaggcatggcacctgacttcttcaatactctgccttaaataa    73500
tgacttcaaatggcaaggggaattaaggttgccgattgaattaggtttgctaatcagcagaccttccaa     73570
tagggagaatctatcctggattctcatatatattaacagagaccctccactgtggatgcagaagactcaa    73640
```

```
aaggagatcagagttggtgtaaagcaacgtgagaaagagatacctggacattgctggctttgaatatgag    73710
agagccaggagaaaggaacgcaggtggcagtctctagaagccggaagagacaggggaaacagattttcct    73780
tagagcttccagcaaggagcccgacagccctcctgataccttgattctagccccatggaagaaactctga    73850
ccttagaactgtaaaagaataaatgtgtgctgttctaagcttactaagtttgtggagatttgtcttagtg    73920
gtaatagaaaactaaggaagagtttatcaccctgtaatattatttgaaattcataatgaagtattactc    73990
tgaaaacaaaagttcagagtctctgaagttgtttggtttcgggccttctggacccctctccattctggga    74060
ttctacttccaagaatttctagttgaaaacacccttgggcacttagagctttctaccttgctcaagcatg    74130
ctaaggagatcatatcaattcttattttagggcagacattttttcagatttttaaaaatgtattttttaaa    74200
aatttgagagataggtaccctgtctctgaatggggtcttgcactgtggcccatgctgcagtgcagtgtca    74270
cagtcatagctcactgcagcctcgaactcctggccgcaagtgatcccccaacttcagcctcctgagtgtc    74340
tgggactataggctgagactactatattgaggttcagagaagaagcatgtccaggtgtctgcaaattaga    74410
aaatggtggcagatttttaaaaaagaaacgatgaaaaattatccctgattagatttacattacaattttt    74480
cagccaccatgactggctagttttttaaattttaaagagttggagccttcctatgttcccagactggtc    74550
tggaacccctagcctcaagtgatcctttcatctcaaactccagagttctgggattacaggtgtgagccacc    74620
acgcccagtgacattttgcaaatttgacattttgcatcatgttaatatagcctcatggccaattgtccta    74690
aatggtatattcaaaagataatactgttttgacacagaaaggtaccaaaggggtcatttagaattttttca    74760
ggaagctataacagatttccagagtagatggctttgaatgacatataacaaaataccgaaattgttcttt    74830
cctcatctgtctccacagagtttcactcaagatcgcggctgcacctttacatgtcttattttcctactta    74900
caaacactgctgacaaaatcctctgtgttcccactccttccggctacaccttaagctgtggtctcttct    74970
gggcaaagtgattctctgacctttcaagctacaccttgtttcctcctccaaccaaaacttgtttgctgg    75040
agttgaaatgccagtttagcccccttagcagatcagtcattatgggcaagtgacccagcttgcttgggcca    75110
cagtgtcctttatgtctaaaatagaggcggctgagaggtttaaggttttaatccatataaagtgcttagta    75180
gccagcacgtacaagcaccctgtaatctgatgttagtgcagcatcattaataacagaaaagggaacccga    75250
aaatttcagcaaaattgcatgtgcatagtgggtctggtatgtatattagtctaggcataataaatgttga    75320
acgtctgtgacataactattgtagtagtagaggggtaagcttaagaagtaagaccaataaatagcccatc    75390
atttctggcagtttctagtatggttttaacaaaagggaattttgggaggaataacattttttaaaaagagc    75460
ccactattatcattctgcttttattcctaacttttgtccttttgagcctgtgttatcaaatggattttgag    75530
catatgtgaattagagaaattaatcactaggaaaggattagaattaactttttttggaaaagtccttaaa    75600
ccgtgaaaaggcagtaacaccattctttgtgtgtgagattaaagagaaattaatttttcttttctcttcttg    75670
tctagacacacaaagtccaattgtacgcatacagtcacaaaatataggtgaaaaacgaaaactgtgttaa    75740
cacggtgagacagatgttttaaccaatcaacatcaacatgcaactaggtgaaaataattaaaattactcca    75810
gttttcatctgtcagttggatgtttgacattgtagtagacagcttataagtaaagataattatgaaaga    75880
ttattaaataaagatctccctgacacggattaattgaaaagtatttagtattttttgtaagcacagttaa    75950
actggagtggatttccgatagcatgtgtctctcccccagctcaaaaagctttcagcaatttgaatactga    76020
gtaataatcttattgaggggtttagaaattacatatgtttggaataatactatttagtagtatgaattatg    76090
cctgtttgaataattaagaaatatcttttcctaacaaagaacattttcccttatgtacataatcttccaa    76160
tacatgaattttaattcaattcaattttgcaattttgcattcttgtcataatttgaacaaatacagattacc    76230
tagaatatattaaaaatcaaattttcacatagtgcatatcataagaatttttttttagaaatttgtcagag    76300
atagaaacttttaggtacaactagtccactggaatatttggccatttaaaacaattagctcattatttatt    76370
tgtggagtcttgcttcctaagatgttgtagtcttatttgttgtcaattaatattgctggtttgaacatgg    76440
ttatttattttccgtactattttagccaagctattaattttttattatttattttttttaattttattttttt    76510
ttatgtttgagacagtcttgctctgtcacccaggctggagtgcagtggtatgatctctgctcactgcagc    76580
ctccacctcccaggttcaagtgattctcctgcctcagcctgccgagtacctgggactataggtgcccacc    76650
accacacccaggtaatttttgtatttttagtagagatagggtttcaccatgttagccaggctcaaactcc    76720
tgacctcaggtgatcctcctgccttggcctcccaaagtgctgggattacaggtgtgagccaccgtgcctg    76790
gcctagccaagccatttaaccttttaaatatttagtgtcctcagctattaaaaataagagtaatatgatta    76860
tacatcctatgaatttgttttataattattgtgattttgggagtaaacaactatataagaaataattataa    76930
aagagataagattagtgcatattaagactttgatgtcaggttaattgaatgttaatcccatgactttatc    77000
tttcattgcaagattctttgcctgagtggggtactgtgaagccattgttgagagtagatccgatcttacta    77070
gactgttggctggttctcctaaaaccaggctgttttcataatgagttagtttaacattttgtctttatgt    77140
ttaagcaccccttccttggtgcagtcacagccaaactgcaaacagaaatcgagaagttgtgagctccag    77210
atttgagagccacagagagtttgtgagatcaaaaacatccactctcagtaaataaatcagagctacctaa    77280
atcacacagtcagcttaaaggcaagggaaccagaggggaaaaactccaaaggagtgatctcttcatgcaat    77350
tgctactggtaaaataaagcaaagatgagacagtgtagtctccaccttattatttcaatctaatattcta    77420
tattgaggttcagagaagcaggtccagatttccacaaattagaaagtggtggcttgctcttgtaatccta    77490
gcacttggggaggtctaggtgggtggattgcttgagcccaggagttaagaccagcctgggcaacatgaca    77560
aaaccctgtccttaccagaaaaaaaaaaaattagctgggcatggtggtgctggcctgtagtcccagctac    77630
ttgaggggatgaggcggggaggatcacttgtgcttgggagatcaaggctatggtgagctgagatcacagca    77700
gtgcactccagcctgggtgacacagtgagaccctgtatctaaaaagaaataaaagagaaacatttcctt    77770
gttagactttacgtatctgacgatgacttttgatggtgaaggtaggcattggtatgtggtctgtggtgtg    77840
tgtgtgtgtgtgtgtgtgtgtgtgtgtgtgtgtctgtgtgtgaatgctattgaaggaaacccggta    77910
ggagaaatatccacaattcagttaagatcaaacatgttacaatttctgggaagtgccaagttttacaac    77980
acctaaactatatcctcttcctctctgaaaccccaaacatcccaaagtctccttcaagccagacatcctc    78050
ttggtctactgtgcatggtgtctgcacggtcctcaagttgcctcaggggaaagtgcctgttgccatcaga    78120
aagaaagaatgcagcaggtactgatttatctcaggcaaaggagctcttgtggtgggtttcaacaagatat    78190
gaaaattgtaggttcttgaacactccttttcttcttccttaaaatggatgtctttagctacattctactc    78260
tcttctctgtctttatgacataatcagtcattcactcaacaaggtgaacatctaatattcacctaacatc    78330
ccatttgcctgtcacatatggactttagcctccagtcgggccaatgacactattgatctcctaattccaa    78400
tctagactctttgggtattttttctcttttccattcctatttctttagaggcattttagataactca    78470
tttaaaaattattagtaaataaatcattatttgcaatcagcatagacaaggccttgggtgagtctaagtg    78540
gatatctgagagatctaaacccgctgctggaaaagtgagtgggaaagcccccattgatatgtgacccaac    78610
taaaccaacgtttcatcaaaagcagtgtcttcagggactgctttaggatttcagggaaaagaaaatggag    78680
gcaaatctgaaagtggatgttttctatggaggatccttgatagaaaagttttcacccagccttgagtgaa    78750
```

```
tatgcagagcgtaaacacatgtttgtgcagtgaggaaatgctgtctatgtttcctaaaatggaagttctt      78820
gtttattgcttctttagctgcacggagacataaaagatgcaaaactggggagaagggagagataaaacta      78890
agacaaaactggagcagggtgcaatgatgttgtaatttaacatgcaaaatactcacttgggtattttta      78960
aattgttacattgtgacattggagggttcataaatggaattccatccaaactaattctaatgcctatctt      79030
ttcttttagcagactatagaataaagttaaatcaaagaacatgaggtcccattcttaccaaattcaaat      79100
atactttttatcacctggtcgtttaaatcattaatacaaaagctttcagtcctccaaatttctattcta      79170
gtaaagtactttcataattttatattggaaatgtactaatccagataactagtatgaaatcaagttataa      79240
tactattttgcatgtttctaaaatgtttcactttaaaaatagagaagtaagccttagggagaaaacttca      79310
gctttcccaagaatattaaaatgttaacaaattatttcattttgagctaaaatcagataataatgagaac      79380
aaatttcaccatcgcacattctacagggatctttgcatttatactttttttttttgttttgctttataag      79450
aggggattttggtatattgaatatcatactggaaatttacctggacggaaacgatagagtcaacttagac      79520
tttaatcacagaatgataacatcttccaaggagaaggagcttttgaggtcatttcaccaaaactctttca      79590
ccatacagtattttcccgttcattaaccttttggcactctaagcagagatgaagtatcctcccctgagtt      79660
cctagaagttgaatttaatcaccattttacgagtctgccctccccagtagatggtaaacccctttgaagac      79730
ccagagcattttgagataaaagaatgaatcatatacttcagtacatggaacaaatgaataaacctgtag      79800
tgcctggccacccagcttttttttttgaacctgaccgataaagacgtttacagcttttaatttcattatc      79870
agagaaagggttggcaatatttacctgagcactctctacaaacagagatgaagaaatttggaatgtttcc      79940
tttctctcctaatacatagctttggaagtcttagaaaacatgttggtatgttccttctaggtagtcttt      80010
gcaagcatcctcttcagtgtcaagcatctattctcatgcatcacattacaggttatgaatataccccagag      80080
tttatgtgagatcttttttttgtcaaatgcattaaaccttggcttatatatattgagctggaagccacaa      80150
gtttttgtaatattttaaaagtaatatattttataatatgccttagaaattaaaaagaaaatagaatacc      80220
tccacttcctatgacaaaatgtcagcatatacagcaaggcaaagccatttgttgctgaagctcagttttt      80290
cccaccggatgctgaatgcacaacaatcaccagccaagccaggatgtctgtttactgcacgtttccctgaa      80360
atgccaagcccctgaggtgttacaaggagggaaggcagcatacatgtgtgatagaatggccaataaacta      80430
attggtttatagttttgagaaagcagctggttgcctgtttttaaatgcagtggtctataatttgatagaa      80500
tgcagaaggaatcattccaagaaattaattaaagttcataggttggaaaataatggagctcatcattag      80570
ggaaagcttattctaagacttaggataaaatgagcttcctcttgcatttcattcaacttaaggttttgta      80640
gttacttgtcatcatcaaaaatatcatcagagtcatcgccatcatcataaatttgagtagctatg        80710
agaaggtattgtgaggtcctagctttagaggaatcaatttcttgagatttgatattgttattttaagac      80780
tgcagagcataggttagaatctgtgttttaaaaactttgacaggccacgtcataggtagtaaagttttct      80850
cttggcatgagttttgagttgacttgtgttatggttgaattgtgtctctcaaaaaaattgtttatgtctt      80920
aactcctggtgcctaggaatttcaccttatttgaaaataggattctgcaaatgtaatcaaggtaagatg      80990
agttcatactgtgttagggaagatcctaaaccaatataattggtgttcttgtaagaagagacacaacaa      81060
caaagacagaaacaggggagaacaccatgtgaggatggaagcaaacgttgaagtgattcatccctaagcca      81130
gggagcactgttggaaaccaccaggaaccaagaacaactcaatccaagacagaagcatgaaatggatttt      81200
ctttaagagcctctagaaggaatcatcttaatttggactctgccccagaacagtgagacaatgcgttct      81270
tgtttcaagtcaccaagtttgtggtaattagttacaaagccccagaaatgaatgcagtctggattaggta      81340
tattctgcgtacatatgctgcctaagaatgccagaagccagaagaggtgatgtctgcattttttggtttcct      81410
aaaatcctctctcagtacccactgctctgtccagggcaaagctcccctgacacatttttagcctttaggc      81480
tatgtcctatctcccctgctcaccagagaagtaggtcttggattccagtctctcagggctggcatttttcc      81550
aagtgaaagacactgcctttgtgtaaatccttccccctttgagtgtaggcaggacattggatttgtttgtg      81620
tctcatggaatatggtagagataatggaacaccacttccatgattatgttacataagcatataaattgtg      81690
tcttactagtataccctttttgttgcattcttggtttccatgctttgatgaaagagcagccatattaaac      81760
aggtgcatatggcaagaagctcagagctgcctctgaaacaacagccagcaaggaacagaggctttcagtc      81830
cagcagtccacagggcattgaatcctgccaacaaccacataagtttggaagcgaaccttcctcagttatt      81900
cagctttaaaatgagaccccagctcaggcaacaccttcatcagtgagagacttcaaagcagtggaccct      81970
gctaaggttgtgcctggattcctgatatgcagaaactcataaaataaatacattacttgaaactgttaag      82040
ttttggttatttgttacatagcagtcaataactaatgtggcataatatgcaaaacatgatttcagctga      82110
gcacagtaatcccagctccttgagaggctgaggtgggaggattgcttgaggtcaggaggtcgaggctgca      82180
gtgagctatgatagcaccattgcaatcatagctcatggcagctatgagcctgggagacagagcaagacct      82250
tgtttctaaaaaaagacatggatttcaaatttggccagattgtaacccaacttctacatagatattatgt      82320
ctccattggagggatatatattttgagactttgcaatccttaattacttaggaacaattagttagcaagt      82390
gaaagaaattcaggttgaattcacttaaggaaaagaagatttcggggttccatttactagcggtgca      82460
tttagtttcgaaaatggtgtcctcaggtctaatcattgctgttaggaatctgcactttggcgccatgtt      82530
tcttctttggcttcttagagaggcttgtccgtgtgtggtggtaggcagtcaacagcatttcctagtatg      82600
tcatccttttctcagagaagcacattggcctagcaactatgcgtactggcctaattttagttgcatgcca      82670
accaatgtctatatccagtggaaagagatacttgaattgatatggactgcttgggttatgtatactcttc      82740
agaaatgagaagagattgggtaagtccagtaggcttagggtagatggaagtaagattgctccccagagga      82810
aaattgaatgctaggtaagcaaaactcattgatgtccattgttgcttatattacaaatagtaccaaacaa      82880
gaaagaatggcatggctgcttcatggaagaggagatcaacttggggcaaaaccttacctaggatatttcc      82950
tttttttcagctaaaagaggaacttggacattcagaaatgagaaaacttgtatatcagttgctgttgttg      83020
ttggtttgtaaacagctgtagctcttagtgacatagagagataaagtgacaggaacagatgaggatattt      83090
ctattaggatgttatccaggcagttctatgttgggagtcaccctcctgggacactcctgggtctggaagc      83160
tgtcagctggtggcaaatcagagatagtctgagatttaatgccagatgggaaacgtgaccctcaaatgat      83230
gaggctgtttaggagtgggcgcaacatgctgtgcttgccatctcttttaagagttctaactgaaaggtta      83300
ggtttactgaaggataagccaatttggggagctgatctggtgaacatgaatttggccaaacttcagccta      83370
agcgtttagcagggtgaaagtttggaagagtttcgttgtagaacattaggcaaatggctgacaaaagag      83440
cttccagttctctcacaaggaattcttcacaaagcaaaggaggtccttctcagtcagcctgctctttctg      83510
ctcagtagacttcttttgtgagactatgctgtgagtgagttctccaggctggtgatataacctggtcttcaa      83580
ttcttgtgcagctctgtaagtccacgtaggcaccactaaatatccttacgacattaagtgtcattggatt      83650
gtttgctaacatttgcttccatatgggccccaggcattagcaaacatgtagtttattcattttatttattc      83720
actcagtgaatatttattgaacttattctaattgtcaggccactttgctaaatgttgttccatcacttc      83790
cttgcagaacatacaggggaaaatgcacaactaactggaatcatcatttagtgtaatccatgcaatgatg      83860
```

```
caacaagttggggagatgtgagaacatctgggagaagcatgtgtcccagactgagagggtgaaaatgcac    83930
taaggagaaatttgaagaatcagtaactgaccaaattgctgggaggagagtcatttcagacagacagagg    84000
agcacgttcaaggctgaagtccacagcctgacattaatatcgattctcttagctaagttttgttaaagaa    84070
accaaatgacagtgaatttgaagtcctgcactcagccaaccgtatgaagtgtagtcactgtatggtcagt    84140
taattacagggcagcatccttcagtcatcagtcgagctagagagaatattgacagatgtgctcttatgaa    84210
acctgagaagctcaaccaggacaagtatttagctaaaagggggtctgacctcctttttagagatgggaagc    84280
aagggtggacagcataacctgtagactaaatctatcacactgctgtttttgtgaagggtttaatggaaca    84350
caaataagccctttttatttatgtattgtctatgtctgcttcacactacaaagacgaagttgagtagttg    84420
caaaagagaccatatggcctgcaaagtctacaatatgtactatcttacccttttattttaaaaagttttct    84490
gaccccctgatgtaaaggaccaacttcatgaagtcgcatgtggatttctagttaccatatagacatgaat    84560
ggaagagtacagaagttccatgtcagacagcaattgttttcaaacttgctatgaattttttccaaatgca    84630
gattcctgggctccatccaggcttccagtgactcaaaatctgggtatagattccaacaatttgccttta    84700
gtgaccttagaggtgatattgatggcaaaaattttatatatgtacatattcatgaaacagaaaattggac    84770
gtgaaatattttttaatccacatataaacagatactcctttctgtcattaaaaaccaattaggaaaaaatg    84840
ataaaagcctgattttaaaaccatggtccatatggcttatgcaagataattttctgaagtgaccttcaag    84910
atgaaatagttgcaaagtatatctgtgttcagttaaattaggaggtgtgtgtgcaacaaggaattattag    84980
ccgtagatctttaaaatcaaatcaatgtaaacaaaacactgtcagcccagtggccaaagaacacaatcaa    85050
tcaaaatatgaataaatatacacaattatacactactactagatgatgatgatggtgatgatga    85120
tggttatgatggtgatgatgaggatggtgatggtgatagtgatgatggtgataatgatgatggtggttat    85190
cgtgatgacgatggtgatgatggtgatggtgatggttatgatgatgatagcaatgaagataacaatatt    85260
gtgatgataatttatggcgataataatgattgtggtgatggtctgtttctatgcgtcaatctcagttgct    85330
cccccagactccatacaaacagaaccaccttagagatgtttcaaacttaccatgttcgaaactcagctgc    85400
tgcttttgacacaatgaatgccctcctgtctccatttttaccatctaggagaactcacaccatcccctc    85470
atcactcagtgagccaagtgtgctagctgctgatccacatgtctgaatggccgccttgaggaattgacat    85540
taccttgggggacctacagggagcaatgatgctggactggggcaaggatgaataaaggagggataagtcca    85610
agttgttgggggaagacagggcagccaactctatctggagctctcagatgggtttagcggttgtggagat    85680
atttccaatggcattttgaagacgtggaagaatgttattaggcatagcagagattcttaactaagagcaa    85750
ttttggccccactgtaagggacatttgacaatgtctagagatattgttggttgtcacagctggggaggtg    85820
ctactgacatggagtaggtggtgaccagagatgctgctgaacatggtaaaatgcagaagaacgactcaca    85890
cagcagagaattatctagtccaaaatatcagtagttctgatattgagaaacttggctctgtattgtcat    85960
gtgtaatcgttttttacttactgattctagattcagctggcaagggggtgtcagcaatgtctggagatat    86030
tttggattatcccatctgggcagtgtgtgctcctgacatctagaaggcagaggatgctgctaaacatcct    86100
acaatgcacagtacagccctcacaacaaacataatcatccagccccaaatgcccacagtgctgatgttg    86170
tgaaaccctgctcaagtcaaagcattgtcttactcaatttttaattcctagtgtatatcagtggttctc    86240
aactttgggggagggacaggtttgcttccagtgtacattggcaatgtgggaagcatttttgtttgttg    86310
tgagtatggagtgtgttactgggaatggaggcaagggatgccactagacatcttaacagtgcataggaca    86380
gcctccacacctcagaatgatctggcccctaatgtgaacagtactgaggtagagaaaacatgaggtagac    86450
tgtagaagcctatagaagaagagaatctgagaaaattgtgtgcttgggaacactgaagaatgtggagc    86520
aattgaacaaatgcttgtgcagacagattggcaccaaattgcaatggagccaccaatgggacagtgaaaag    86590
ggacaagtcctacaatgcacagttcttgaccatcccaaagtgctccaaagctacagaagttggtgtgca    86660
tgtattatctcattgatcctatttgggaattatcatgttgacagctggagtcccatgaaggaacattttt    86730
aagcagcaaagtgacaagctctgatttgccttttgagattaatgactcagagactgccagttatttgtta    86800
acttgcttgattcagcctaagcagacatctagagggtgtaatttgatttattctgcagaggggtgattgg    86870
ccccctacattatcttggcacactgcctgaatttctgaacaccaaagacttatttatttagtgtatggcca    86940
tctcatttccaagagtcaccaaagaagtgagaatgcattagataggaacaagctgaccattggattagt    87010
ttatcagatgattagcatgccatgctaatttatcaagacatggaacatttaaagaaggggagagtaacat    87080
atacaggggaagataggagatctttgtcccaattatttctttttttttttaatgcatgaatagtctttggta    87150
aatatagtttatgtttgtctgcttttctaagttaggctgcaaaatattattatcggtggtattcttttg    87220
aaattgattggcatggcaagactgtaaaagagtatccataggtgtatttaaaaataaaagatcgtctttt    87290
catctttgcagaaaaacatgtatttactattgcttggaatagaaagcagaattttgctgtagccattagg    87360
aagtgacaaacactacgccataattatagtgagaagaaagcatcaaaaagaaatgttttggttttttta    87430
tatacagttggcacaaaaatgtccacatatatgaatactctaaagaatgcaccataaaaagaaccttcca    87500
ccactattaacaggattaatccgtgctctcattaccatgggattggggatacatttttacatgttcttgatt    87570
agattcaagagccaaagaataaggcctaattgatgaaagtgggctctaattttgtgcttttaaaataatg    87640
gcctctggccaaatatgggcaaaagaaacagcacttgatttgttactttacatttgtttcttgcatcctg    87710
ctcgaaaatagagatgatttacagttttaatatattttttcatgcacaattaacatcattgttgccagttt    87780
tatagaagaggcaggaaagtgggccttctatgatttattgtgagtgcatgaaacagaagtaatgctacta    87850
gcaacagagttttagtaggaaaaagttaaagcacacagtcttaaaaaggaaaggttggtgtcaaaattat    87920
gttttgctttaggtaagctttatacctccatggatggcttttttatagtaacaacaacagtaactgtatt    87990
tacattggggccttttctctgtttcagaggctttcatgtggagtgccaaaatggtaaaatatataacatt    88060
gttatatgaaggagtgagggaaaatccaatcaagattggcatttttaaaaaagaaaaggagcatgggga    88130
atattttaaagatttggggcaagcctcgtggctgatgcctgtaatcccagtgttttgagaggctgagga    88200
aggagaatcagttgatccaggagtttgagaccctgggcaacatgcgagacctccacctctataaaa    88270
aagactaaaaagttagctgagtgtgatggcacgtacctgtagtctcagttactaggaaggctgaggtggg    88340
aggatagcttgagcccaggagggccaggcttcagtgagctgtaatcacatcactgcactccagcctgggc    88410
aacagagcaagacgctgtgtctcaaagaaaaaaaaaaaaaagatttggtatctttcttccccccacag    88480
tttgcatatacattgaaaactgtgcatttaagccaaaatagtttttttttttaaacatttcactataaaa    88550
aaggagtctggctttcacatgggtacatgattttgcttttgcttcttcaattcccacctgccctgttgtg    88620
agacccatgaagtaagcaaagcattcttttttgccacggaaatgaaactcctaaacatattgtttattgtc    88690
acataatgaaaggagaaacgtttcaaaaataaggatacatgaagccccttattgaaaagcaatcatacat    88760
tggtgaatttaatgttttggagcaaaaactgttatgttggatacctattagtctttttagctagtgaaat    88830
atgtacaaggcaaaatcaagcatcaatagaagggtctaactaagcttgtttctcatatggtttctctgcc    88900
agctcacacctcaaggtgcctcctgcctgcaatgtgtactctcggtccacacactgatttcccctttt    88970
```

```
ctgtttcatggggtgacttgctgaccttctctgtgcatggctagtagtactctattgactggcaagggtt    89040
gtgtcttccacttgggtcttccaagctgctgaagaaagcaacacagaaagtatagctgacaataattatc    89110
tgtcaaatgtatgtgaatcacagtgtggatggtcgacctgttgttttcttttttctctttgaaaggaagat   89180
ttcagttttctctgcagccatggtactttataaattatttcctctccatctcttaaaagtcactgttat    89250
ttaccaccccattagctgtggatggggtgaaatgcccactcatgcagcacaggaggatacacagattgtc   89320
acacatcttttcaggagaccacacagcagtgggtagtgtagtactaaataaatgcctgaaatatgagctg   89390
ggaatgcattgcacttcaaggaatttatccataggatgtaactgggaaagtgcagaagaatgcatatat   89460
atatagttgttcattgttacatgttttatgatagcaaaaaaaaattaaaaaatattcaactttcattta   89530
gacacggatttgcaggtttgctacatgggaatactgtgtgatgctgaagtttgggtatagatcccatta   89600
cccaggtagcgaacatggtacccaacaggtagttttcaacccacatcccctgtcttcctccccttcta   89670
gtagtccctagtgtggagtgttcccatatttatgtccatgtgtactcagtgtttagcccccacttataag   89740
cgagaacatgtgatatttgtttgtttctattcctccattaagtaaccaaaattttttaacaatgtaga   89810
atccattacataattagagatacaatacaagcattgaataccagctgttaaaatggcattacaggataat   89880
atttagtgatatggaggaatattcagagtgtattatatacaaacattttcatcatatcgttttttactag   89950
agtggactgtcatttcttgtgggctcccttgtattatttactctattgcatctcagttttgttgcatat   90020
tatgtaaaatagaagataatgatagcttggcgcattctctgctgagactatttacagtggtgtaaaaga   90090
tgttgccaggggtgtgtgcctcagtctgtcccagccttcgtagggcccatgtttcaactccctaatgac   90160
ccattgaagacacacgggcacacaggggagaatgctctcgtttaacagtcaaccataagccagacacag   90230
tggtgcaacctgtgttgcaccttgtggtagcctcttgctacccaagaggctgagacagaggatctcttga   90300
ggtcaggagttcaagaccagcctgggcaacatagcaaaactcccattctaaaaaattaaagcaaactcaa   90370
ccattttgagttttacatgttgtaaatatcttctcccactggcacccacccatcattcctggttttgatt   90440
gaaacaaaaccattagttttaatgtagcaaaatgccatcaacatattttctttctaacggtttctccta   90510
cgtagtgcctgttaaagaaatcctgttctaccccaacatcacaaaaacattttcctataagtatcagaat   90580
ttcattgttcatacagacagttttaatccatgcagagtttattttttatatatgaaatgaggtgggaatc   90650
tcatgttattttttttccccaataggggaacattgctttgacacatgaaggaagcaatgtattcttttttt   90720
tcttttgagacagagtcttgctctgtagcccaggctggagtgcaatggtgcagcctcagctcactgcaac   90790
ctctccctctcaggttcaagcgattctcctccctcagcctcccaagtagctgggattacaggcacacgcc   90860
accacgcccagctaattttttgtaattttagtagagatggggtttcaccatgttggccaggctggctcga   90930
actgctgaccttgtgatccaccctcggcctcccaaagtactgggattacaggcatgaaccactgtgccca   91000
gctacaatgtattctttcccaatgatttgtggtgtcagccaggaccttgatagggataaatggcatgcaa   91070
cttgagaaatgtaattaagatggggacaggatagtggagtcctctatgtgaagttgctgatgcccgctgag   91140
gttgaactggacctacctaccagggagggaactggaggtcatatatacaggccttactcgccttctgccc   91210
tccggattacctgctagtgtcttccttggctgaaacccaggagcagccagaaggcaagagtgaacctgtt   91280
tatttaccttccacaccagagaggagtggagatgaggaaaagtcttgaagggacagactcctcccccca   91350
caaaatagtacaagcttttaaaattcatcatatatacatcagccaatccaagggctttatatttggtctt   91420
gttgatttcctgatccattcctgcaagattaaagtatgactcaaatagtacaaatgcccatatattttc   91490
atcttcaacattctcgttgcttttttgtagaatttattctttcatatacaatatggaatcaatgtatcaaa   91560
atctgcaacattcttctgctttgctgggaattgtatttattgaaatgttggttgaggaaaataaaca   91630
tcttccaagctcatgttatctcatttgtaaactggcatagttcattacttgttgagatctaatcatagct   91700
ttattaaagactttgagcattatgtgttaattgattattattattattttgcaaatgatatcttcaatta   91770
cattttctactcctggtataaaagaatgtcgatcttttttatacattgattatatgttcagccatctttt   91840
ttgattccctattatttctagtagcttttctgttaaattacatggtttccataaaaatggtgacattatg   91910
tacaaataatgaccatttctctctcttttcctttcaatacttgtaatttttcatttcctttataacttgtacc   91980
attgtatggcccactgacgtccagtgcgaggatgaatactgttggtacaaacttttgttcccattcatga   92050
ttttacaggaaatgagtctaacatctttttgtaaatgcagcgttgaggagagattttaaagcatgcagt   92120
cattatcagataatatgaattacttgcaattcccagttttttctaagtttttaaaaaatgttttcttttg   92190
ttcataaatgttgattatgaccaaataatcaactggcatttctacagctggttatatgattcttctctta   92260
taattaatgtgctctgaaaattaatatattttaaatatatattcaatttcgggaataacacattttttaa   92330
tcttaaaagaaacatttttaaaatggccattattctattatagtggaatatattgtatatgaaaaatagc   92400
tactattctactaagtttggttgtaaatattccacttaggttgtctacatctaccttcataaatgaatt   92470
tgatttataattttctgatgttatacactctatactttgatatgaatgttaaactgtccatacaaaagg   92540
atttgggtagctttctttaattgtatattttctgaagaaaacttaaataagtagaattactaaaattttt   92610
gtgaaaattatcttgggtggtgagttttatgtggggaagtttttagtgattcttcattactacttatag   92680
cttttagtttattcatttctttgcgtaaagttgctttgtttgttttttttcctcaaatatttcaatttctt   92750
tttttaataccagggcttatactattaaaatagtattttgtattttttataactttgtttatttgttatt   92820
ttaaaaatgattttcctcttttaaagactatttgttctcattatttgttgtatattatttgttgtatattg   92890
ttgtatattattttgtttcattatttgttgtatatgttactcttgctttggtcagtcttgccagaagtttgt   92960
ttatattattaagcttttcgataaactagctttcattttggtaattagctcaactgtttttttctctgtt   93030
cgctaatttctgctcttaccttgatcatttcctattttcagatttatttggatttattctgttttctctt   93100
cttcctgtttcttgacttgcctccatggctcgtttattccaattcttcttgttaccttgtaaagatatt   93170
tgaagttttaattatcccttttaagcacttcttcagtcccatctgacaaatttttcacatgtgacatttga   93240
actatcactggactctgactgtttttgtgtttatacggtagcataaaggcacatgcacacatatacataca   93310
cacatagatgtgtgtgtatatgtttagtgttctatcattatttttgaatgcttttttactattgatttct   93380
aattctgttgaccgatagaatatagtgctgaatgctgctgtttcttttaaagtactctttatgaaaggcag   93450
attttgtaaacgttcggtgtgtgcttgaaagctatgacacatttacacatacatagacatattcacaaa   93520
tacaaatacagatatacgtgtatatgtgagaatgtgtgtttgaggagcataggtttccatagatacca   93590
ccagatcacatgtatgggttacttcagtcttctatatctttattgttttggtgggtgggctagggacag   93660
agtctcgctctgttgctcaggctggagtgcagtggcctgatctcggctcactgcaactccggcattctgg   93730
cttcaagtggttctcctgcctcagccttccaagtagctgggatcacaggtgcacaccaccacgcccagct   93800
aactttgtatttttagtagagacgcggtttcactttgttggccaggctggtctccaactcctggcctca   93870
agtgatccaccagcctcggcctcccaaagtgctgggattacaggcgtgggccactgcaactggcctatat   93940
cctcaattacatttttattcctaagtttatcactccaagaatgttgtgttttattctactgtaacatttt   94010
atcttttccttatctgtcctttatcttatatatttaatgtatatggatatactatgttatatatatgtagt   94080
```

```
atgtatatataaaatgtacttatatacctttcacatgttttgaagctgtattattaggatgttacatgaa        94150
agtgtcagttacacctttttaatcttccattccttttctagtatttattatccatttttgacatttacaa        94220
tttttgtttgatactaaatttgcttcctgtgatattttttcattatattttgttttatatttaaaattt         94290
ttagtgtcttcattttcaagtttatgtatccatttattttaaatatatcttttcaacaatatgttgctaa         94360
aagtattttaatcaatattttatcttattctaattttatttctgcagttatcattattatagatttcac         94430
ttctgacatttttattttatattttatatttatcaatcatgcttttaaattttaccttttttttttttg         94500
ctttacctgacttccattatataatttaaaagtttcttttactgaccttattattatattttctttct          94570
tctgttttttttcttatagttgggattcatcaaatttccctcttcccattttatgctgcacttatatt          94640
ttaatgaagatgtatctagtcttattagctatcaaacatttcagtatccataattttcctcaaaacaaga         94710
tattgatttagcattttctctactcttcggcatctctctctcaatcaccccacactgtgttagattct          94780
aagagaatctgggctctagatcatgttaaaaatttgattttagatcattgtttcttcggaataatttttt        94850
gtcgttacctgtattatgttgctgtgttctgggttcctctccttgcagaaatatattgtgtcaagatttc         94920
tgtgatgtaagtggatttggatttaagctatcatttaaatgacagtttcactggacataaaatccaggct         94990
gattttctttcccttgtacttgctgggggtgagaagccactgcattttgtatcctacgttgctttgcaat         95060
tagcctggttttcattccttgcacatcgcctgcttttctccttggaaaaattagacatattttgttta          95130
catttgaggtactcaaaaattggaatttgttttgctttgttctgttttaaatcaacgtattatttactt         95200
tgtgagtactttcacttttaagccttttttttctttcattctgggaaattctcagcctttctgtctaat         95270
gtagttcttcctagtcttttctctttgttctctttctgggtcatttttttttataggactggtaacact         95340
tctatttccatcttccatacttagcatttggaggatgtttttccaccattttcatcccagatccattt         95410
tgggaaaatgtatctctgtcttttggctcctatgtgcattgtttgtgggtatccttccatttcagtctgt        95480
tctttgtgctctccagttcaacaatttcatttcttctccccggtatctcgtgtgacttcctttgaaaccc        95550
tttgttccaacttttatatcgctatcattgtctctctgtccattggagggatctgcttcttttgaatccca       95620
gtttgtttacttgggtcattttattattattttttaaataggatgttcctttcttttaagtgcttt           95690
gcttttgactggctcttaaaaatttcttgggagttcttttattttcttgaggccggtagaggtcttgga         95760
aggtaccaagtgtccaatgggcaatcaaaagcccacctctctgcctggcgcggtggctcacacctgtaat         95830
cccagcactttgggaggccgaggcaggtggatcatctgaagagttcaagaccagcctgaccaatatggtg        95900
aaacccatctctactaaaaatacaaaaattacctgggcatggaggcatgtgcctgtagtcccagctact         95970
tgggaaggctgaggcaggagaatcacttgaacccgggaggcagaggttgcagtgagccagagattgtgccac       96040
tgcactccagcctaggtgacagagtgtgactgcatctcaagaaaaaaataaaaaacaaaaaataaaggcc         96110
cacctctcgatttcatgcctctgggtaaattggagggaaaagagggtccctctgtgaagagcccttggaa        96180
ctcgagttctaatttctaaaccaagaactttatattcttcctccctcccatcacttccatccactggc         96250
tggctcttatctgaaaactgtcgtgtgcagttataaatactcaacacttagggaaggagaaggaattctg        96320
agagatttcgccagcctgattcttttcattgccataaaattccactgcttttaccagaaatccttggaatg       96390
tggctttcctagctttgcactgtgaccttcttcattcggaataacgaagatgagaaaagcattgatccgc        96460
ccagacagtgaggagcgaagagcaatacctaggtggaaagctctatctccctgactgtcctgtgaaatg         96530
cacctgagtctcagaggactccactgccatctgtctgtccaggaatttcccattttgtatggcgacttca        96600
aagtaggtaaatactttgattaaaggaatagagaacagaatttgggtagcttgttcaaaagatggcatgg        96670
aaaattctgtgactggagtagttgtgaagcatcactcttcccgtaagaataaaggaggcatttgccagat        96740
gtctgaaaacacacagacacacacacaaaggaattacttctggctgcaagaatattctctctcagcatct        96810
tcctgcatctccatgggcaaacagaccacaacagcctgggatttttaattgccaacagttttcattgc          96880
atgagagcctgacatgtctgttgcatgatagggtgtgttttattttttggcttcctattggtttcaacat        96950
atccctccttccatgtcataatgacaattacaaagacctgagttcaacctagaacgctttttttttgtca        97020
gacacaacaatgcagtggatgttagtcataggtaattcaaacagagataatttgtatattctagaata          97090
ttatgttttcaaacgtaggttttgatgtaccataagatttcttctgccattgaggcgatatatatgtgtg        97160
tgtgtgtgtgtgtgtgtgtgtgtatgtatatatatgtgtgtattttaaatttaaattagatattttt           97230
agaggcttagcccttaagcagaattccctcctaatttaatgattttggacgaagctcattgtgaatcat         97300
ttaaaaacacattcatgcttcttcaaacagagagtaacaaaggatacagcaccttgacttgttgactaagt      97370
gctgtcatggtagatgttatttagcatagaagatgcctgcagggtcagttctactctctaaagtttcttg       97440
aggctgtgttaaatgaaatcaaacacctgtggatttttattcttgttcacgcttttatacctctcctt        97510
tcttctccctgggcaacctgctttcacactagtgcctacctctgttttcccttcagaatgtgatctatgc        97580
tacacaatctgattaacaagctcaacagagttctactggacatagaataaagaaccagtatagttttct        97650
ctctagggacaaggcagtgaggaagccagtttgaatacaggttcttgctcttgtaagcattgacattcag       97720
caggttccttactttctgaacactgcagttatatgatgggcagacagggactaagaataaacacctacctc      97790
aacggggctgttgtgaggattactgagataatttatgtaaatcccctagcacaatgcctgactcatgcgag      97860
atctttaattcatggtagcagttactaatttcatttatcataatgagctgcctgagctaccaaggagctc      97930
tgccactcccagtactgttctacagttcttaattcaacaaagaaattttctttagttccaaataagtg         98000
ccaggcatcaggctaggtgctgggtgtatgatgatgatcaaaacagtgttcgtatgggggtagtcatcat       98070
tttgtcgatgggccattttttatgatgtccctcttcattataggtcttgattcttgcctctgtttttgtat       98140
acatatgtgttgcggcaggggcttgctataaaaatcagaattgcccaggctgagcgcagtggtgcaatca       98210
tggctcattgcagcttcgggcttcagtgatcctcccacctcagccttcttagtagctgggattacaggca       98280
cactccaccacacctgcctctgttttgtgtagctgtgattacgtagcaatttctgaatcagtgacaaga       98350
tgcaatgcatatttttttcagtaggttaattaatttatctaatctacatttggagctatttttggagtg        98420
ttagtcatcatcataaatatgtggcactgtcaatagtaatataaatggtaacttaattccataa            98490
tacaaagatcacgtcttcatgactgatgggccatttcaaacccataggtacatttgctcgctctgtaaag       98560
tatacaaaagtaagaattctggacatctttaaaagttgtaaattttacatgaaaacttacattcacacc         98630
atcttttgaatattgaaaagatttgggaacatggggcctatatgtgactgtggatgaggtgtggctgttc       98700
cctttagacacagcactcacttttgccatagtcacactccccaccgctccctattgtgtctccaaccccca       98770
ggctgttgtctgtttcttttccaacgttattacccactcatagatggtcaacctttatgatcattgttact      98840
ttcttttcctcagaatctttctagtatttgtgattttttcatgtcggttatttttgagcttttttgcattaa    98910
gaatttgggatcacatactcaaaagtttagtatttaccagtttgtattattgagcacttcagaaatttat      98980
ttctgttgctgttatcaactcataaaatatctgtttaattatccaactaaagactagataggatagtgat      99050
tcctatttttctccaagctcatatctgtgaactccttgattgcccaacataggcattcaatcattcattca     99120
acaaatacccattgaggacctactatgatctgggcacttttctaggtgctgataattgtagtgaaatagt      99190
```

FIGURE 8A-23

```
agaccacagtggacagtgtttctttatggaatttaagtgaataaggaagttatttggagtatttcagat      99260
cgtgattcctgctacgaagaaaaataattcagaataaagtagataaggaataataggaatggacccacac      99330
agttattattttattgctgtggtcatactgatatctgaagcaagtaagagaagagtttcctatgaggat      99400
ggaatagcatgtgcaaagaccctggagttgtagaatcctgatgcgtccaaggaatatggagaagaccag      99470
ttgggctagagttgacaaaatgagggtgaagtgggggtataagaatagagaggtgctggacagtaggccg      99540
ttgagagggcttagcttttccgtgatgaatattggaacccacaatgtaattttgagcatgaaaatgaga      99610
gccttgatttacatttttatcagatcaccctgagttctggttggagaatgagctctaaggatctgtgggt      99680
atatttagggagatacttaggtggcctttgcaataatacgctcaagggaggatgctggcttcaccagaga     99750
gctgatagataagccatggccagattctgggaatattttaaaggaagatccaacaaatcgattattccta     99820
gaatgcagaatgaatgagaaagagacaacttatggccaaccccaattcctttggccgccgtaactggaag     99890
aattgcgttgccatgtgctgacaacagggagattgtgagaggagcactttagggtgagggaattaggaga    99960
ctgcttttgtttaagttaagaacaaccaaggagagatagatgtcttagagacagctgggtacagtagtgt    100030
ggacatgaagagagaggtctacgctggagatacaaggtcaggagacatgagcatgtagatgatatttaca    100100
gttgtgagactgaatcgcatttccaacacaatgaatgtagatagagaggagaagttaagtgtactagaaga   100170
aaaagaaggatgaagaggaggagagagagagaagacagtgaggaagaggaaagaagcagcgtgcatgtgtgc  100240
acttgtatgagaaagagagagagagagagggagaaagtggaagatatagataagaggagagagagagagact  100310
gggggaagaattacatccacccaaaacccaaattttaatgacttacaatatgaaagcttcatttttttt     100380
tctcttatgttgcacctcactgatggactatcatcagccccacttctcttccaagtctttattccagaat    100450
ccaggctggaggccatgcctgaactgaggaaatggtgttcatgtacaacagttcttcagcttctgctca     100520
gatgtggcattgcacatccactcatatgcgattgtccaaagcatttttctattctctgggagatacttca   100590
agggggcacaacagtggctggggattgaggggctgtgaatagactttcaggaaaaaggatcagctgtgct    100660
aaatgctgctgatgagtgcagtaacacaaggatgagtaacttgagtagcttgtagagaggtataggccat    100730
ttgtttcatgcccaggaacaaggcaggaccaggaatcctggttgagatgctgcagtttgggctagttgga    100800
ggtgggggcaagttttttctctcactgctgggacttactcaggttaacagatgggacgttgtggaggagct   100870
ggagacggaggagaaagtgtagaagagttaactaggagatggattgagagtgtttgatgtgagaggcagt   100940
agagcatgcattgaacctaggctgtatggttggagggttttttttccagccatgtcctgtctgctcaggtt  101010
cagaggaggtaggaggtagattgaaccagccacaggtgatgctccatgagtaaagaagggttgagagtca   101080
ggaattgaggagtccaaggcattaactgaaaagatgttcatggaatttaacaaagatgcggacaaatat    101150
gaggagaggaggcagtcaaggggagagagaaagagtagggttgggatacagggaatgaaagtgagctcctt  101220
aagatgaatggctaatcccacaaaactggccaattcccataaggtgaacggctaatcccattagtgcatt   101290
gttgacatgaaaatgtcctcaccaaataatgaagaaaaatttgatttcttatgtggaaaaagcaggacc    101360
aaaagcaatcaaccaaaatcgtatctactacctggcagtccattagaacacactaaacacacacataaag   101430
agaaaaatgaagtatgttaattgtgaaacttgtatctccaaaaactggaaagcttcttggcacttaaaag   101500
cacttcttggcacttgggattacttgcctgtaatcccagcactttgggaggctgagacgggcggatcact   101570
tgaggtcaggagttccagaccagcctggccaacatggtgaaaccctgtctctagtgaaaatataaaaatt   101640
agccgggcatggtggcgcatgcctatagttccagctactcgggaggctgaggcagaagaatcacttgaac   101710
ctgggaggcggggctgaggtagaagaatcacttgaacctgggaggcggggctgaggccgaagaatcac     101780
ttgaacctgggaggcggggctgaggcagaagaatcacttgaacctgggaggcggggctgaggcagtgaact  101850
gaaatcgtgccattgcactccagcctgggcgacagagtgagacgctgtctcaaaaaaaaaaaaaaaaa     101920
aaaaaaaaaaaaaaaaaaaaagaaacaaaggttcaataccctacttgttgaatgaaagtggacgtgtga    101990
attcaaagtttccgctctttcacagtgttttttttttttttttttttttttgacagagtctcggtct     102060
gtcgcccaggctggagtgcagtggcacaatcttggctcactgcaaactctgcctcccgggttcacgccat   102130
tctcctgccttagcctcccgagtagctgggactgcaggcgccaccaccgcctggctaatttttttgta     102200
ttttgagtagagacggggtttcaccgtgttagccaggatggtcctccatctcctgacctcctgatgcaccc  102270
acctggcctcccaaagtgctgggattacagacatgagccaccgcgcccagcctcattcagttctttatt    102340
acatttgtaaaggtaactctaactccgtgagagcactttctcgctcacctcttaattcttgagcaaacag   102410
agaagctgtgcatgataaagctggagaattgggtggtgtcttcctattaagcttacaggaaagcactggg   102480
catttggaacagattgttgcatcttgagagccacagagttcaggtgtgcacgttaaaacgatgcttctaatt 102550
gttgcatagagacagaagacaatcacaaagattctgccttgacctccttacctctccagttctaaaaaca   102620
tttctcccactacagaaagcatccatctatgtgtttttgcctccacgtggtcctattcctgaaatgctc    102690
cttccaagtctgtactttccaagagctactatttctggatcttttgcagttgcttcagcaagaatcagt    102760
tctggcttccttggttctaccatgccaactttaccttctcgtccctcagtgggatgctagggcttgggtt   102830
aattcatctctctccttcaaggcgacatgaagccccctgagaacagggggcatattttgcccagccattac  102900
ctacaatgatacaggagtcctgtaatattcgttagagaaatgtgccactgaacatgaatttcctatcct    102970
gttccttctaaaaaaggatgcatgagttatcctatattcccaaggcacaacatgactttgttctgatatgt  103040
gccaccgtgatcctgtagaatttgttttgtttccagtccctaagaataaatgtctcttaaagtattgtag   103110
tcattcactctacatttttatgagttattactggcccacctacaaccatatttcctccgaaattcatcca   103180
tcctcctggaattacctgattctgaattattaagtggttctcttgctcatttgctcaaaaaagagcaca    103250
cttattccaacacacaggcattgtttctaaattattattgttttttcttcctagaaaccatttagagatg   103320
aagatccacttagaacatgaacccattagtttagactataacaattgaagatatggtgactactgttt     103390
atttctgttagggatatattttttgtagatttcacaaaagacagaacctgctgtgtgacagcttatctgc   103460
aggacaccgatggttgtaggacgatggtgaggctttgtgacaaggcagaaatgtggaaggctggcaaga    103530
ttgtttactgagcttccctaaggatggaataattccacaatcccacaatcctccaccctcagtcacta    103600
ccaatagctgtgcctcagtgtttcttttaatgattgtatgtattaagaaaaaaatcctcatatgtagt     103670
gtttagtttatctgatttcgttactaaaataataaaggagaaaagtaaataattcatataaaagtaaac   103740
tttcttattccaagcaggtgtatgtgtgcatgtttgtgtgtgtgtgtgtgtgtgtgtgtgtgtgtg       103810
tgtttgccacttttgatggaaagaggctgactttgcagagactattttttgttaagaactttccattaaat  103880
tagagctttaagttataacactgattgcataggccagggaaaatggtaggatgtggcttaaaaggcaatc   103950
tcacaagaagtatgactttatcttatattataaacaacagcacaaccttggaatttgtcccaataaatt    104020
ccataagtataaaataaactaaataagtaaagtgactaatatcctactaagtctttccttcacacatgc    104090
ttttttgcctaaagccatttaaagtctctgaggatttaaatctatgattctttcatggagtagaagaaac   104160
ccagagaatatagaaatttagaaaaactttaagacttattggtttaacagaagtaggccgggtgcggtgg   104230
ctcatgcctctaatcccagcactttgggatgctgagctgggtggatcacttgaggtaggagttcaatacc   104300
```

FIGURE 8A-24

```
agcttggccaacatggtgaaaccccctctctactaaaaatacaaaaattagccgggcgtagtggtgcaca        104370
cctgtagttacagctacttgggaagctgaggcaagagaatcacttgaacccaggagacagaggctgcagt        104440
gagctgacattgcgccactgcacttccagcctgggtgacagggcaagactccatctcaaaaacaacagca        104510
acaaacaaaacaaaacaaaaaacccagaggtagatctaattctgcagactgcaatcactcagttatggat        104580
ggataagtcagtccttaagtccatctgctatttgtgtatcgtgcattttttttttttttttgaaacaagca        104650
cgttcccacctggattgaatgttaatattcactgaaagccagggcattgcaacgagcccttaggatgtta        104720
taattctgggccattttttacagttcaggatttcagatttattgcaatgttgtaagttttttagtttcttgt        104790
ctttctctaacatctagtaagttccaaaacttaaagaactacaggttttcttgataaatacctgtgtcac        104860
tacttttttattttttagatttttcttttttactacatgatctgagttaaaagttaaatatatatgaattat        104930
tgttttgaaaaatattacctataatagtttttttaaaagaaactttaattttagatttgtgctaaattggc        105000
gaagattgtgtagagttttccttatacccaccctcaaattccactactagaaacaccttacatcattat        105070
tgtacatttgacactattaatgagccaatatgtgtgcaattttttactaaagcccacccattcttctgat        105140
ttcgttggtattttccttctgtctttttttctttcctcaaatcctatccaggatcccacattacatttagc        105210
cgtcatgtctccttgagctcctccttgactgtgacagttttttcttcttttttgtcttttcatgacctttaacagt        105280
tttgaggagggctggtcacgggattggtaccttgttttggtttgtctgatgttttttctcatggttatactg        105350
gggggctatggattgtgcagaggaagaccagaggtgaagtgccactttcattacattgtatcaaggcac        105420
atactagcaccatgacattgcagttgatactaaccttgatcccatggatgaggtgatgttggccagatat        105490
ctccagtatcacgttcgtcctcctgcacacacactttctatactgtaccctgtggaaagaggtcactacg        105560
tgcagcctacacttaagaaagcaggaggccgggtgtggtggctcacacctgtaatcccagctactccaga        105630
ggctgaggcaggagaatcacttgaacccgggagaaggaaattgcagtgagccgagatcgcgccattgcac        105700
tccagcctgggtgatagagcgagactccatctcaaaaaaacaaaatgaattaaaaaaaaaaaaaaaaga        105770
aagcggggactataatcccctccttgagggcagagtatctacagaaattatttgaagttattttgcatga        105840
gagatgtgcctattctcgcctactcatttcatttattccctcatttacatatatcagtatgatgactcatgga        105910
tatttattttatacttttgggttgtaatctaatgtgatgttgttatctgcatagattttgtgtttacgta        105980
acttttttttcaaattcctgagggatagcttttttagaaaatccctgtttttactttagatccaaggattac        106050
gtctgcaggtgtgttacaagggtatcttgtgtgttgctgaggttcaggcttccgttgatcccgtcactag        106120
gttattctgtgcccagataatgagcacaggaagtttttagtccttgtcccccctctgcaacagattgta        106190
ggaaataatctgagactgatcatttttaattttcaagcactgaacatgcgattttatttatctagaaggta        106260
gaccagcaaaacaaaattatatttgacattttagcatataagtatttctagttaactttgacatacaag        106330
aagccaggttatgaatgtatttgttcatgactctagcttgtttggttaaaattattctcctgccaaccaa        106400
atgcttttttgctaccctgaatatttaaaaaattttacaatatttcatctttaagagctataaatgtat        106470
gttttaatatcccagggtaagatataggatattttttagtctgtcgaggctgctataacaaaataccttt        106540
agactgggtaatttataaacaatagacatttattgttattattcattaagacagggtctcttctgtt        106610
gctcaggctggagtgcagtggcttgatcatggttcactgtagccttgacttcctgggctcaactgatcct        106680
cccacctcagcctcctgagtagctgggaccatacgtgtgtgccaccatccctggctaattttatttttt        106750
taattttttagtagcgatgaggactcactacgttgaccagggtggttttgaactcctggccttaaacattt        106820
ctcctgccttgacctcctaaagtgttgggattacaggtatgagccactttgcccagctaacaacacacat        106890
ttatttctcatggtcctgggaagtccaggatcaaggtgcagattcagtgtctagtgagggcccatt        106960
cccccaaatggcatcttcttgatttatcctcacatgttggaaggacaaggtggaagggcctgcagcctc        107030
ttttataaggacactcatcccattcatgagggtagagttatcatgttgtgtattggatttcagcatatga        107100
attttgggaggacactaccattcagactatataacaagatacattaggtttggggtgttctgcacttgag        107170
tgaatctatgtaagcccttcacatatttttacttttcactgaaataaaactaaataaggaaaccaatgct        107240
atcctatatcttaaaatgagaatggtttgtaacagctcattgccttgcatcatggtcttttagggttagg        107310
gttcgggttaggtttaggattagcttcgctttgctgggcagagtaggtatttccgcctcgaaccacctct        107380
aagggcttcagctttcagtaacgcacctgtcacttctaatgcaaaaccttgagtcctctgtctgtgtgca        107450
gattcaggaacaggttttgaggtctaagaattttcttattattgccttccatttcaatttctagttcctcc        107520
aaagtccttcacaatgatgaccgagaggagacactcaaaaatttgttagccagagtctcaaagtacatag        107590
aagctgttttctcttgggtggatattacaagtgcctctacaggcaactgcattctttctctttccaggat        107660
ttttgcttattgtccagatatgctcctcctagtgagagggacacttctgattttcctgcctccatggaa        107730
cagggcttcagagaagaaactctctacagccccttcgttccattaataatttataattaaatgcatttc        107800
cagcatgaaggctgcctaggagtagagaagcatattagaagaaccaatctgctgcgtatctgcttataag        107870
gttgagcccagtcaaggagggatgcacagaaactcaggattctgacagccccctttgcaattggg        107940
agggtcgccaaatttcttcttgcaaggggtacttactgtctgtgagtgggagctcttgtggataagga        108010
gtgagggcagagagggaacagcagagccctgggaagttctttccacttgactctgagcgtctagacagca        108080
gcctgcccccacccctagattggctttgtacctgtgagcaaagtttctgactgtgccatacatctctgg        108150
aatacatttagttgctaatggagatattactataattccacatatgttttagtctctccttggggctgt        108220
gccctctgtgtggcttggcagaagagaaaggagagaaagattatacatgcagccttgcttggagggga        108290
gtgaaacctgtgattttcctttctgtgtcaggaaagcgttttctgctgcttgactagccacctcccag        108360
gcacattaaccagtcaggtgatgctgacatttgtacccctaatctggcttatttctgaaaccctcccttt        108430
tgagcctaactgctataattaggagactggatcctaacaggtttggaaaaggtttgcaatctcaaat        108500
aaagtagtgatttttgaaagagaaatgtatagtagagttagctatgggttttgcacattctacattatgt        108570
ttgttttgttttttttcgctcagactgctcacagatgcagtgagcacacccaaatgcatgtgatcaa        108640
tgcatgtctgacttctgcagctatgaaggtctgggtttgtaagatcactgctgtagacccttgtttgac        108710
ctttttggattgctggatcagaaagtgagagattgcgaaagtttttcttaaaagaacaagtcagtgaatca        108780
attcattaattcttttgttcattaggattagttaatatactgctacagtaaaaccttttgttattgtctg        108850
taataataaaagttggattatggcatggctaacccaatctccataacaatctgctcatagtttgacctc        108920
attctaatataacccttgtatttcacgtgattgaatgtttgcaccatatttataatattacatccaggta        108990
ttacttggtttctgaaggtttataaaattgtaaatgcagtacatagggtattagagattttgttgttta        109060
ttttttttagagactgggtcttgctctatcaacccaggctggagtgcagtggtgcaatcatagctcactgt        109130
aaccttgaactcctgggctcaaacgaccctccacccctcagcctctggagtagcttgtattataggtgcat        109200
gccaccatatccggctaatttttatttttgtagcgatagcatctcagtgtattgcccagattg        109270
gtctcaaaatcctagcctcaagcaatcttcctgcattggccttccaaagtgctgggattacaggtgccag        109340
ccactgtgcttggccattacctagagttttttgttagagataatgaaataagaatgagattaaaatgaggt        109410
```

```
tagtctcatgctgcttaaaacagtgatatgcttaggagcagctgcaggaacatctgatccaatcttggag    109480
gcagcctggagggcttcccaggggaagcacaatgtagtccaaaacctgagagatgagcagggattgacta    109550
actaaagagcagacctacacaccaaattctgccatcagttccttgcatggcatggaaaattgatttctac    109620
aactacgcagtattttctcttcctttttttttgaaacagattctcgctttgtcacccaggctggagtgcag    109690
tagagcgattttggctcactgcagcctcgacctcctgggctcaagtgatcctcccacctgagcttcccta    109760
gtagagtagctggtactacatatgcacaccaccatgcccagccaattttttatttatttatttatttatt    109830
tttgtagaaacagggttttgccatgttggccaggctgctcttgaactcctgagctcaagtgatcagccca    109900
cctcggcctcctaaagtgctgggattacaggcatgagccaccatttttatttggtatgtgtgcattcata    109970
gttattctacaaaaaataatatttaataataattcacagtatcctgcagattccaaaataaagtaagctt    110040
aagttctgttggaaaatgaattctgtgagaaggctttggtgctttgacttgaagctgacatcaacatta    110110
gtgttgggcatttggctacacacctgtcacattcaaaagccaattcactttgagtctttattttgttggc    110180
agtaaggggctgcacatttcgatccactgtgtattttcctagcccagattccactcaaagcagaggtttag    110250
agaaaaaccccttgtttattgcaaatattatgccaaaaatagggatgaggaaccagcactgtgttgtgggaa    110320
ggaacgagaaataatcactatttacaatagccgagttgtggaatcaacctaagtgtccatcaacagtgca    110390
ttggataaagaaaatgtagtacatctacaacacagaatactaggcagccataaaatagaatggaatcatg    110460
tcctttgcagcaacatgaatgtggctggaggccattatcctaggtgaaataactcaaaaacataaaatca    110530
aatatagcatgttgtcacttataactgggagctaaacaatgggtacacatggatataaagatggaaacaa    110600
tcaacactgggggactcaaacaagggaaaggctggggaggggtgaggggttgaaaaattaacctatgggtac    110670
aatgttcactctttgtgtgattggaacccctagaagtccatatgtcaccagtgtgcaatatacccatgtaa    110740
gaaacctgcacatgcacccctgaatccaaattaaaatttaaaaacaaacaaaaacacaaaaaagtgtatt    110810
ggccacagaggagtgactgctgcttgacccagtgaggttgtctgaaaacccttatgttatgtgtctccag    110880
accaccctttacccggtgaaaatggaggacccatattcacaccatctttcacctcttattagtttactggg    110950
ggtaacctctccaggctgcttgggggagtgctaagtaggctttagtgtgcatccactgtgaggcatcagag    111020
aaacttcaggaaatcaagaaaaaggcaagtttgcaggtatgaagtgaggctgcacctgcgtgaagctggc    111090
tgaagtctaggcagagcagatcaccacaagagcggctggaataagccatgtggccgaatggcatccagca    111160
caacgatcaagtgaaacagagctcctccagctgtggtagaactagggccaaagtatgtgaaagtgttcaa    111230
agattcttcgcattgaattcaagctcatcattgtccacaaatcaagaccatgtctataattggtaaag    111300
aaagaataaagcataaattcatatttcaattttttaggttatctgaataaatgaatttcaagagtgcttaa    111370
ggttttttgctagatgtttgcaggttttttgcctggagaggcacaggcagttcttttgtcctatcattctagc    111440
cttccacttgtagggattccctggaaagttgacataaccgctgattcctagttctgttttgtgggaagta    111510
tcaagattaagagaccctctgggtgaacaagatgtctttcaatagatgaatgggtaaataaactatggtg    111580
tattcagacaatggaatattattccatgctataaagaaatggctattaagcatgaaaatgacatggagg    111650
aaaattaaatgcatattactaagtgaaagaagctgatgggaaaggctacatacagtatgattccaacta    111720
taggacattctggaaaaagcagaactgggggacaataaaaaatccatcattgtcagagtttcggttgggg    111790
atggggaaagaaaagataaataggtggatcatagaggattttttatggcagggaagatattctgtgttata    111860
ctgtaatggtggatgcaaggaggttcttttgtctaattaactgttcacattcatcataattgattccat    111930
acagtatgcatggattttcaggggtccaagtgttaaccaactcaagttcaaccactctgtaaatgg    112000
ggtgctctttagtgtttgttttgtttactgttctaggactggttaatagaaatcagaggacatacagatc    112070
cagagtcccctatctacaatttgaaagtcaaaaacagttcaaaactttacagtgatatcaaaactcattt    112140
gggggcaaaacctgatctgacagatgactatttgtgttcttctttctttcaacctcagggtggacatttaga    112210
tatttttcctgcaggaatattaatgagtttgatttgggagtgatgttccatattcctctgagggtgctgca    112280
taaaacagatgtaaaaaaattaaaaagttctgagtccccttcctcttgtccacaaaagcatactccattcc    112350
caagggtttcagatccccattggtggatctgtgatatcaaaggtctccattgataatgttggtggtcagtg    112420
gaaaatagttgtgtggagagagatgtgttagtctggacctcatgcaatgactgcagaaataattttatga    112490
tttccaaagaacaacagacaatctaaccacctcccttacctttaaagactgacatctgtgttgtgttcat    112560
ggatgattatgcaaatcaagaaaagtggcttccatcaaaataatgtcatttcttttttggagaaaagagcc    112630
tgggactgagttgtgttatgtgtgcagtttgccagctaaactcctggcttaatgattgggatgggtttcc    112700
aagggctggttctgagactcagtggcagttagttaggtggtaatttccccattaacattaatgagaaatg    112770
aaataagttacttaagaaaacgtgctagacgatagtctctaagtactgaaaagtaaatgaacccacctac    112840
gtttgttcacataaaatttcttagtatattttaaatttgctaatctaatgtacttttttttttgcttgtg    112910
ctttaactttgttaaattatgtcacgtaaaacattttattccatattctaaattacataaatgtgtcaca    112980
cacaatgtcatgaatcaagtttgtctaaagaggagataggccaaggcaggtggatcacttgaggtcggga    113050
gttcaagaccagcctggccaacatggtgaaacccatctctactaaaaatacaaaagttagtggggcatg    113120
gtggtgcacacctataatcccagctactcaggaggctgaggcaggagaatggcttgaccctgaaaggtgg    113190
aagttgcagtgagtcaaaatcatgccactgcattccagcctgggagacggagtgggactccatctcaaaa    113260
aaaaaaaggagataatacactttcacgttttgtaaaataatgtttaaatggtctaatgtgattttat    113330
cttgctaatccagttaccgtcccagtatctgaattatgataacagtttacgcagcatagttttctaacag    113400
ttttggttccatctctgctattaaattcaggccactggatctgtttggttcaacttggattagggtgtga    113470
ggttctgtttttcctacctctaactccatatacattgtccgtgctcctgaccttccatgcaggaggcttgc    113540
aggtatctccttaatctgtctgtcatctgtttctttctgccatctcagggactcctgatctttccagact    113610
gcccatcctcctgtcccttttgactcttccttttttgttcttctgtaactccagtctgatcatcta    113680
aatagtctgagggggaagtgaggtactgaaggcactcttgtgagaatatttctcaggttcctaggtccaa    113750
gtttccgttgcatcttggtttctatttcagtctgagcagagagagagagagagagcaaaaaagatctt    113820
caggataaaagtgagagagagagaagatgagaaatataataataatgacaactgataaatgccttgagc    113890
tataactctgccaaatgaacacagaaactcatgtgcagttagatattatccacctgagaatgtagttgat    113960
aacatatttcatcataaataatatcgtctaaagcccttacttgggaagattatgaagcaagcaaatctt    114030
atgcagtatgtccttctgttctcttgacaagcataagtttctatttctgtattgctagaaattttttagtc    114100
acatgcaattccaacagtgctttaagctggttattactaagtagaaggtaaatgtttgatgatgaagaa    114170
tttgcggtggaggtgaaatttaggataaatattagcaactttgaaagtaaggtgtagatctgtgcggta    114240
ccagaaaacatttaacagattcagaagttagtttatgtgtacctatatgtgcacacacatacacacacaa    114310
tgcatgcacacttatgcaaatcacacacacatgcctcacgcacaagtgcaacactcaggtgcacccaatt    114380
gcacatacgtattctattactattcttttgcaatgctttgaatgctcatcatgtaccacaaagttatggtc    114450
taattcataataccataaggtgcgtgtgctttagagatactgtgtattcctttcaacatcgaactagtg    114520
```

FIGURE 8A-26

```
actattaatgttttaaaatcaaatttgataacattctgaaataaaatactgatgtattaagtaccaatgc        114590
gttgacatcaggtttcataggtgttgaactgtagcgaggaaaacagttatcaggtgtcctactgtaactc        114660
tacccagcaggaaagctctatgtaatgatggtagaatatccaatgatggtgtccacatctgcacaggta        114730
cgatttgagattcactgacttatttaggaggattcagtaaaatttcgcagatgttgttatgtagtaatat        114800
ttggctcattcatattctgcactcctagacattgcagaaagacatgcaactgtgatttccatctcatccc        114870
tttcaccctatttgaaacatttagttatgtctactagttaccctaagttgtatttttaccctctaaaa         114940
aggaacaagagaagttggaatccatcccagctttccttccagaaaatggagggggaggaacaattggaatg       115010
gagaggaactccagggagaaaaagacaaaaggcacatgagtgagtttgtctaggctgggagagtgggcga        115080
tcacatgagatttgtgaactaattttgttctccttctgtttccactgataagcactttatgagtgccacc        115150
agtgtaagtaaatattaaacctcatctcaattagtatctactcttttccaaatatatgcttatgtcagaa        115220
aatgagcagtagaaagcaaccacaggataccacctgcacacccacgggctgagcattgcatactttcaag        115290
gagtgctgttgtgttttcaaacttagtaatttcccaaaacagagaattcacagcttccctaatcaccttc        115360
ctcagaaccctgaatcttgttaattgagtcatttttctgatgatcatgtactcatacaattgactaaatg       115430
tctcaactatgccttcctgataagtagtgtctctacatgtgaagtatctatttaatctatctaccctctc       115500
tctctatctaatctgttgatttcttatctatctaatttatatctatcatctctatgtatctatgtatgta       115570
tgtatgcatatatgtatgtatctatatatatatcgatctatcttatctatatgtatctatcatctctatg       115640
catctatgtatctatctgtctatgtatgtatgtatgtatgtatgtatatatctatcaatcctctct          115710
ctctctcttagttcagcaaattacttacaggttttttgttatgtaactgagcaaaattatatacacacaa       115780
taagaaggctggaagttcaagatcaaagtgcttaccgaattcagtgtctgtggtggggacccacttcctgatt    115850
catagacagcgccttctcactgtgtcctcacatagtggaaagggcaagggagctctgtgggatcccttt        115920
ataagggcactgatcccattcatgaaactccactgtcatgacctcattacctccaaaaggcgcccacctc       115990
ctaatactgtcccgttggggattaagatttatatattttttcttttaattctaattttttgtgggtaca        116060
tggtaggtatatatatttatggagtacatgagatattttggtgtagacatgcaatgcataataatcatat       116130
catagaaaatggggtgtcctctccttcaagcaattcattctttttgtgttacaaacaatcaaattatattatt    116200
ttagttattttaaaatgtacaattaggccaggcacggtggctcacgcctgtaatcccatcactttgggag       116270
gctgaggcaggcggatcacgaggtcgggagattgagaccagcctggctaacacagtgaaatcccatctct       116340
actaaaaatacaaaaaaattagctaggtgtggtggcgggcacctgtagtcccagctactcaggaggctga       116410
ggcaggagaatggcgtgaacctgggaagcagaggttgcagtgagccgagatcatgccactgcactccagc       116480
ctgggcgacagagcgagactcagtctcaaaaaaaaaaaaagtacaattaaattactattgactatgtat        116550
tgactatagtcaccctgttgtgctagcaaatactaggtcttatttattctttctgactataattttttgta     116620
cccattaaccaccccacttccccacatcccaccccactaccctttccagtgcctgataacccttttttg       116690
actctctatgcacatgagttcaatcttttgattttagctcccacaaataagtgagaacatatgataac        116760
agtctttctgtccctggcttatttcacttaacataatgatctccagttttatctatgttgtaaatgacag      116830
gatctgattctttttttatagctgaacaatactccattgtgtatatgtaccacatttttccttttatccattc   116900
acctgttgatggacagttagtttgcttccaaatcttggctattgtgaacaaagctgcaacaaacatgggg      116970
gtgtggatatctctttgatatactgatttcctttcttgggggtttggatataaacatatgaattttgag       117040
aggacagaactttcagactatagcatactgtaccatctatctatctgtccatccatctgtttatctgtct      117110
cccattcctgaatattgcatgcatattttgttaattatttccaatgtcatattgagttttaagtaaga        117180
ttacatttctgagaggcctcacgtgggggcatcctgaaaagtacattctctttatagtttaaatgttttg      117250
gttttttttcttttattttttttcatatttaattatatttctttcaagtgactccttttgggagacatgattt   117320
cctacctcctgggactgccacaattcccctgcctcttggaatgcaatcgatctctagtctgcctcaagta      117390
taaagatgatattcatgttgatgacattgagaaggatgaggagaaaggagttgatcagagatctatattc      117460
atggtatatatgttttatcgtatatatatttatctgcttatcgtcttcagaatataaactccaagactgtg    117530
ggtctttgttttcttcagtactaccttgcagagtctaggcctatttattcaaagcttaatatttgtgaag     117600
tgcatgaatcaataaatgaattctaatgttatcactgccgttggtatggtatctgtttctctatctgtat     117670
tgtcctctctacttttcattatttgtttaattcccactcattgagacagattgcagaagattcctttgcc     117740
aactacttctgggtagagataaatttccctccacggagctcccactggactctacctgcagctatatgtt     117810
atcttgtattttccaacactcagctgtaccacataagacttgattgagtgaagacctagactttagcttg     117880
cataaaaccaaagtaaatgcttccacacatagccattcacagacattttcacattttatacagcaactg       117950
atgaactaggctagtgctgggaacaggcccctaaaatctggccataaacttgcccccaaactggccaaa       118020
acaaaatctctgcagcactgtgacatgttcatgatggccatgaccccatgctggaaggctgtgggttta      118090
ccagaatgagggcaaggaacacctggcccacccagggcggaaaaccgcttaaaggtgttcttaaaccaca      118160
aacaatagcatgagcgatctgtgccttaaggacatgctcctgctgcagataactagccagagcccatccc     118230
tttatttcagcccatcccttttgtttcccataaagaatactttttagttatctatataatctataaaaacaatg  118300
cttatcactggcttgctgttaacaaatatgtgggtgaactgtttgaggctctcacctctgaaggctgtga      118370
gacccctgatttcccactccacacctctatatttctgtgtgtctttaattcctctagcgctgctgggtta      118440
gggtctccggaccgagctggtcttggcaggctataaagacattttctactggcttaacagagaagaaaa      118510
acaaagcttagggagactgattatgcagaatttaatttgcaacaagcaaagacaagtctattgacttcaa      118580
atggacatcatcacattgtcatctgataatttttccagcatccttttgcctcctctgtgttaaattataaa    118650
ttaatgctgatttatacagttcagttcagcttcacaaatatttaatgagcacttgctgtgtaccaggtat     118720
tattatataagtagttctttatggtgtaagaatggatagtagatactttttatccattcaactttaaaa      118790
ggttgatgcctagtcatagataccaggaaacacttaagtgaatgaggacaagttttctgctgtcaaagag     118860
agagatcagacaccaactagagtccaagaaagacaaagtaattttgatcaacaaaactcatagaagaaa      118930
ataagcattctttgttgttacatatactcagagccattttagtgctcaaagtttgatagaaattgatac      119000
acaggacttgctgctctgaattggctatcccagaatatctacgagctacaaccagacctgacattaacc      119070
tgtagttacttgtggtttattcatctatccatctaaatgttatgagcatctcctatgtactcttcatggt     119140
actagactttagacattgaatacggagcaaaaaagacatagtttcttatttaatgtggcttatactctga     119210
tgtagcatttcttcaccagggtaattttgcctcaggggacatttggcgatgtctaaggaccctgtaggt      119280
tgtcatgactgagatttgttgctgatgtctagtgggaagaggccagaccccttcacaataaagaattat      119350
ctgaccaaaaaaggtcagcagtgccaaggttgagaaactcttccagcagttgaagaaaaataatcatcag     119420
atcacccacaagtataattacaaactgaaatacatgttagatgctggtagagctggtttccaaagtttct     119490
gatccagttgtgaggatacatattgatattgagaacggcggttgaaggggcagtagtaagttattaggg      119560
taagaaggtcttggtgagcagagggactttcatgcgaagactccagggctcgaaggagcccactgcagtc     119630
```

FIGURE 8A-27

```
aggatctgaagtgacaggtgtggcttgagaacagcggcaatggggagttaggcaggagggaagctggaa        119700
atgcaggcaggggtagacaataaaagtacgcaggccgtttatattacaatcctgtagacttctttctt        119770
ctttcattcttgatacttttctataataacattcaagcattggatcagcacctttgttgtcttctgtca        119840
tgtagcccaaaggtttaccttggagacacaaaggcaactaagacaatggtttctgcactagggagatcat        119910
attctcactcagaagacatttgcagggtgtgattagtgagtctcacatacatgtcaatttcttcctaaga      119980
ccttgtgctttctagttttttatttttttattattattttttatttatgtatttttatttgagagagcctcg    120050
ctctgccacccacactggagtgcagtggtgtgatcatagatagctcactgcagcctccaactcctgggct      120120
caagcaatcctcttccctcagcctcccaagtagctagaactacaaacatccacaaccacacccagcttat      120190
tttattttttgtagaggcaaggctgtctctacaaattccgttgcccaggctggtctcaaatgcctgggct      120260
caagcgatcctccggcctgggcctaccaaagtgctgggattccaggtgcgagccatcgcgcccaccctc       120330
tagtttttaattggtttattttcttctcatatttcagttgagcattattcatttattgctgttgaggttt      120400
tactttttttttcttcccaaaggtagattgtagacagctcacctttgttaccaatttgaaatgctagat      120470
gttaattcttaatgttgtagctgtaaagggccatgatttgaggacgtgttatttttttaagcctgagttt     120540
ggattggtctgagttgaatgcagttgctaagccatcgaatgagggagtctccctgaactaatgagtgaca      120610
tggaccttttcttataggtgagagtccatttgtgataaaggcattgttttttaggatacataagggtcatgg    120680
tgtatattcttagcaagtgttatgaatacattcgatctatttctttgaattttagtgtttctctactct       120750
ccatcttactaaaccaggtgtcccagatttcgggttcagcacatttgtgtctgggttcacatagagggac      120820
taactaggtggagtttagggtaaggggggtattcagagtcctgccctcctgcaaccacagcaacaccccca    120890
agtctctctcattagattgtatttgttctcctacttatgttctttggcctctgctataaacattttcaaa      120960
aaagtatccaatgaaaacaatgttgtcaatgactgtctttagtaagtctgtagtcagattcatatcttta     121030
aaatatgtacactgtgtgaatatttcaaagtatgtatcatgaaaacaaataaggaaaaaaaaaaaaagc       121100
caagaaagctgagatggctctattaatatcaggcaaagatacctttcaagataaggattatttccaaaata    121170
aaagagagacatttcataatgatacaaggaagaattcacctaagagaactaataatgttaatttgtgtac     121240
acctaataagagagctgttaattatacaattagcaataaatgcaaagaaagactcatcaataatgacagt     121310
tggagatgttaagatgttaccacaatagatgaaagatgaagatagaaaacacacacacacacacacacac     121380
acacacacgatatgaaaattttcaacagcaccatcaatgtccttggcaacttcgtacttcgagtccaacc     121450
tcccttcacaatctaatacagaaacaaacaacccatgattttttctgcatttcgtggttaggttccctgtg   121520
gctcaaggcctctggcgcaaatgatgttgtcttttagattttcatgctaagaagatactcatgttcgtat    121590
gtgtgtgcttttcctctatagcatccttaatgttggcctccagatgagagtctctgacaatgggggcttt    121660
aacatcaaacagccaaagtctctcagcgagttaacctcttttggcctttaaatttctcacataatgacatac    121730
aacagtccgctcttcttcaagtggcctttgaggagtctagggacacttgtgaattcacttccacaactca     121800
gctgcattgcgaattcaattattgtgctgggagatgttgtaccattatttttttttaaaggtgcatattc     121870
taaaggttaatcttgaggctatcacattaagggttaacattttatcgggggcattatagagtgcatttt       121940
gatggctgtgatttcagataacaagcttgttgtttctattttcagctctagcttggcctctaatctgta      122010
gggaaggctggttcctaaatgcaggaaatgaggctcaatagaacatgaaaagccagtgttaatacaccat     122080
tcaatctcaagaaagagtgggaggaagaatgacagagctgtttttttgacagatgagtggttaggcatccc    122150
cctagctctccaagtcaccactaggatgaactttcaggatgcagtgtcctgtggaatttggctctgaaac     122220
ataacttcttcataaggcagatattgtaacgcagttctggattttgtacctacagacagctctgtgttat     122290
ggtaactgttttctgttggcacaacaaacaattagttagtttcatgctgtagaatattttccagatgccct    122360
gatactccaaaccattggtcattgcagcctccatattcagatgtagcggctataaacaggtgatgcatgc    122430
atcctggccagggaccatttgatttttccaccttttctcttcccaaattcagggtttgtccacattagc      122500
actattaaaactttgggcgcttcctgtgcgttgtaagatgtttagcagcactcctggcgtctacccac       122570
tccaagtctttaacacctaacgcccatccttaattgtgacaaccaaaactacctgcaggcattgccaagt    122640
ggctcctgaggggcagcattgtcttcattgagcaccagtatggtaatcctagcctaatctattgtgtta    122710
ccttattgttccttaacatatatggggtagaatcagaattacaggaacgtgaatttctttcaacaattat    122780
ttctttacaattatgtaataaaatcataaaaggtaaaactgtatctttttagaagccaagaagcaacagt    122850
ttatgaaacaaaacctcttttagtatttcatattaatcaatagatattgtggaaaggctagttcttctttt    122920
aaggtaacagttgcttaagagttgaagtgcagcttatgagttttacaagccctgatttatgcacagcttg     122990
aggcattgttgttttgcaactattgttttccagcagcactgctatttttataaaagcatgtatcagcaata    123060
gtatagaattgcatatatgcttcagagtcaatgcaatcattaaatagcatgcaatctgagtagagtctac     123130
ccaaagctggaattcagagcgcatatttatgcacttagcaacattgccataattacacacacacacacac     123200
acacacacacacacacacacacacacacgcacgcacgtacttaaagcctttagccatttaaaaatag         123270
aattcaacaactaaggctcgtacacatggaactcttttcagcaggatttccaatgtgcaaatttgata       123340
aaattactcttttaaaaaaaaaattgctgcaacgttttttcattaacaccataaacatttacacatgatt      123410
cacccccaaattgcaccctagatgtatttaccctgacttggcaatttcatacttcatgtctctacttccct    123480
tcatgcttcaatacagaaacagacaaccgatgacttttctgtatttctgtggctcaagtcctctggccaa     123550
cctgataaatggcttaggctattcgataacctgcagcagatcctctgagatcttctttagaaatttcctc    123620
caagatcctaactacattcatttgtagaaatatttgagatgcaatgcataccctgtctagtatccccccca    123690
cccccataacagaaatgtgaagtagggtgatctgtcatctttgtgcaggtcattgccagctctagcaccag   123760
aatctcctcacctggggaatatctcagtcccaggccaactgggacttggatactctaattctaggtgtgg    123830
ttcaagcatcggtgggttcctataacactggcacagggaaaaacattaacagtgggacagaatagagagt     123900
ccagaagccagaagtgcatatgaatagagaagctggtcccagctgggaccagctttttaaccttgccaaa    123970
tcttgctattgcatcttagcttttcttccttttctttttatacctttctacttttctgtttagtt           124040
tcttctgttttctccactaatttcttaagtgggatgattcactcattacttttttgcccttgtgtttgtt    124110
actgatgtcagtatttatggctttaaattttctctactgctaattttcctgcctcctgtaaattctaaaa     124180
cacagtatttcagtatttgtctattaagtgttaagtgagatttgtgtgacgttctaataaacagttaatt    124250
tttaagtgttttgtgtgtattttctaatgatgagatacaaaattatgtaattgtctatcaaatcatcggt    124320
taactgtttatggcatctgttttttcctattttttgatctattaaaattgaaaataggttttctttgtatct   124390
tccattaatgaatgaatttataaaattcttcctataatactactgatttgggggtttttaaagaacgtatg    124460
tggcataaaatatataacaagttatctccttgaagaatgaaatattttactatgtaatattcttgctatc     124530
tcttaaaatgctttctgttttacaatagatatccaatattagtagaaatatgcttgtttcttttttactt     124600
ttgggttggctattgctgagaatatattttttatattttcacctttagtaatttcagatattatggttgt     124670
atcatttcatatgacagatatctataatttcttttttttcaatgtgacagtttcagtctagtaattgcata    124740
```

FIGURE 8A-28

```
acttatgctatttatgagtttgaagatatttgatataattcaacgtattttaatctttcggatttcttt       124810
tttatgcattccttttaataaatgagtttgttctttttctgtattttcttcttaatttgccatttacttg      124880
atttctactttttcaagaaaagcttgcagttgtaaaactcacatttaagtcattaaagtctaaaattaagc     124950
aagaccttagctccattctagaaaataccaatcacctgtctccctagttacaggctattattatgtatca      125020
tgaatatttgttataaactctttcagtttttgtttgattgaatacctttgttccctgctcattcctgaaa      125090
gataattttgcttattatgcaaatccaggtggaccattatttcacatttcactgtcttctggctatacag     125160
atgtcagttggttttgagttaaactttatgcacaggttgtctttggcaacggctaaaatttaagatctcc     125230
tgtttatttttggcattcatcagtttcatgtcaatattgattttttttttgcttatccattctttctat     125300
ggtttctgtgcctttggattcatatatttaatcattatttgaagatcttagggatcacctttcaaatact     125370
gacacttctccattcttcctgttttctcaaattttgatttgatatatgagattctcattttgcacccat      125440
gtctcctaaattgacttttatattattagtttctgtcttctgttttttgtaagattttcccagacatatc     125510
tttttttattgtcttttcttctgtgtctaatctctttagctaatccattaatttctatttatttcaacaa     125580
atacagttttttattttatttcatttctatgtggtctttcaaatcttccttgtccttttccagtaatttc     125650
ctgttttttgttattgtttcctgtttcaaacttttattttttaaatagctattttaataccacaagtttt    125720
gtgtgcagcacctataatacctcagtgttcatgggcttagtgatctttgactgtgaactcatgtttgttt     125790
gatcttaatctgtgggaattttctggcctatgctggcattctttccccaggcaggtaggttcgctttcct     125860
tctgatagaagctagagtgtaagacttgagcccttcaagggtccaaattctccacttactggaagcca      125930
agcttgggtttctggccccagccccttgtcttacacatctgctgcccttccagctacctgctcccttttg    126000
tctgaggtcagtgctactatgggtgtgttacataagggcagacttcccttaggtccagttttccctttgc    126070
tcaggacacccaaatattcttttgcttacactgttggaggagctttatgtgggaaagcttaattttggat    126140
atttctcttacttcctgtgcccagaagttcactagcaagtgcatcttatcaggaggtaattgttttgtt     126210
cagggaaggtctcccagagtgatgtgttacctgctgatgataggagtggaagcttttcctttgagaaggt    126280
ttcaccaatggaaaaacaggaaggaatgagggaggggaggagggggaagaaagaaaggaag              126350
aaaggaaggaagagagagaaggaaggagtaaaaaaagaaagggaggaagggagagagggaaggagtgaaa     126420
aaagaacaaaggaagaaaggaaggaaggaagtaaagaaggagaggaggaagaagtactgaggaacatctt     126490
actcaatggtgagacccagttcgtacatgttcttatcctatgagctaattttttctcttttgttttttctt   126560
aagagaattggctgtctcttactctgtaatacagatctgtgagaaaatagcttttataaaaagagatttt    126630
gtagtattacacacttggcaggaataatagttgtcgttgtaataatgaatactaatctagaataggaggc    126700
tgagaagaaaaatataattaaaatggtaatggcttttttttttatgtgaatgaaactcatccagtattggt   126770
tttgaaagatatctaagttctaggagcagactgtagcagaatctcctttaatactctaaggaaaggacgc    126840
ttttagaaagtaggcattgcctccttatgtgaaaactgcattccttttcatgagggttccatttctggaa    126910
cacaggatgtaagacaggagacataagaagggatcttgtagcagtgcagatgaatcaagtcactgcactt    126980
tcttatttgatcttattttaaaaagatgcttccagggaagcaggaccttggaacccacaaagtctggagc    127050
aagtcattgacctcgcaaggtattcacgtcctcacagtgaaaatggagaataaaattgctagttttttaagg  127120
atactcttaggaataaataacttgttatagcacatatcagaccatcagtcatgccagcctgttttcctt     127190
ctctcttactctctccctctgttcattttctccatcttctctccaactattcctccctctctaccactgt    127260
tgctccctccctccctccctccttccttccatttttttccttccttccttttctacatccctccttc       127330
ccctctcttttctttttcctttgcttccttttctttttttcttcctctcttttttcctacaaaacagtttg   127400
tcaactttggcactcatgacatgtggagctgatcaccccgtctttgttgtaggaggtgtcctatgcattg    127470
taggaggtttagtttagcagcatgcctgggctctgccagtagatgacagtggcaccactaccacaagtt     127540
atgaaaaccaaaaatatctccagacattgtcaaatattgcctctgaggcgaaaccacccctggttgtgaa    127610
ccaccactcaaaaatacacttcatatcaataaaaatcctgctttatatatatatgttttttgctcagttc    127680
aggggttattaagattgtaagacactagtgtttcttacaaggatgttcttttgattgagtcttta         127750
aaatcttactgttgatgaaaaattgaaattatgttgttatttttatattccttcatatagcagcataaaa    127820
cttggtattttatgggaatgagtatgcatcttgttctgattctatggtctacttttatgtgtctcaaaat    127890
gagattcagatcaaagaaaattaaaacgagagcaaagtgaatattaaggtaaaggtatagcattctgat     127960
tatctgctgcttgtccatctcaggtatgcaatactgacactgtgccactagtagcttccttgacattctta   128030
agatgaaaatagtttagttttttatctaaatatattaatagagaatatacaatatatttattcatatat     128100
taatactggaacaatagagtaaggttaaacactcaaaatttagctcaaccctgagattattatgaagtac    128170
ttacaaaaataaaaactaaaaagacattagtagcgtacttcccagcttcatctctgcaggaggtgttacc    128240
ttagctcagggcttggagaataggacatgtgtttacgtgattgactcttgttgggattgttctcagagct   128310
ctcctgaccttggtccacacacttgggagcacatgattcctaatactgataaccacagtctcatgaattt    128380
ttctcattttgcagaggagggaattgaggcactagatggtaatatcttttccatttcacatagttgctgg    128450
tggctaagggaagctggtgctcagcttgtcccaggccatatctaagacatttgtctggcccttgctttc    128520
cttcctttcatgcatacagcaagcatatccaactttctatgctggtctatttctagaaggtgttatttg    128590
acatggcatcacctcctttgtagccctctgactatgagaatgatagaatgacctctcttttaaacctatc    128660
tccttatccgcccaacacataccccctttggggtggggtcataagggggtatcccttctccacactaact   128730
ttaccgacttctctcttcattgtctctctgcagcagataatgtaagcaagaaaaagattaactaattac    128800
atgcacctcaagtttcagtaggaatatcccacaattcctctgtctcttaatttaactgttatttattgaa    128870
cacctgctgtgttcttgggaaaattccaggtgctggatgaattagtttatgatgatagctaagacttgc    128940
agagacattaatgtgctgttcttcttcttcttcagaaagtatagccatgtacaaactactaaagggcgat   129010
atcaaatgttggggagataaatatcaaaatacagagcttccatacctgtagttttggttagtttaatagg   129080
cgttaacatttactcatttttcagctacctacatttattgagctatacatattaatttaa              129150
ttgcataataaaattacactgtatttgctgtttatagaaattttagaaatttagtttaacgatatgtttata  129220
attttcttactactatggataatacatttaatgactataattaaattcttgcaaaattttttgaattgttt   129290
ttagtaatttgccaatgattttcccaggtattaatttaatatattgaaatttgtctttatagcatagag    129360
gttttttatttcattcatttatttaacaggcatttatcattcatctgctttatgcaaggcaaaaaaatggt   129430
caagcaaggatgccaagtcttaacctcagggaacttacagtttatgtacaggacacatacttatcaa       129500
ataaacagagaaaggaatgtatattcatatgaactcggcatcatatattcttctttatgttatcattaat    129570
aacatccaaatgtcaacaacacatctattgttactttggttaaaaagctacacagacagtagtagatatg    129640
gtacttggatgaagaaagctgaagtttattattttctctttctagttttaatcccctaagggtcattgata   129710
aaagacttacacaaaccccccctttagtaaacctaataatgtataataatcctgttcttaaaatggtgatag  129780
agatttgcttggtttctactacataacaccataataccatattaagacttgaatctctttatatcatgga    129850
```

FIGURE 8A-29

```
acaactcaggtagtgttacaaactgctgttactgaataaatgcggagaagaacaagctctccagagcagt       129920
gccatgcctgtgtctgatgtttcccaggatagaaaactgcgcagatgttgatggtttgtttcaggtgctt       129990
tgacagcctgatcatgggctctagccgtggaccatgaaaaatggcttctgcagggcttaagaaagacaa       130060
tgaagagcttcgcatttctcttggcatttcctgctattgtttaaaaggtcacatatgcaatttaaaatg       130130
ttccatgcatggagcatgacaaatgccacgtagaaaatgaaactgctttcgttgacattttggccaatt       130200
tccaaagggtaccattttccgccttttcccttttgtggatttgcaaaatttggcttgtgcaaaatgcgtg       130270
ccccacggtgcactctaggttgggaagtgccacatgttaggtagaaaatcgtgtgtagatgagaatggca       130340
cattcagaataaaagtgagaaattaaatgacatcaaaaaatagagaaaaatagagaaaaacttgtaaat       130410
gagtccatcagaactatcagaagctcaaaaagaaagaaaggcttagaactcatcaataacaatgtccagt       130480
ctcattcatatgtaaagaaagtgaaatcaactttattttagttaattttacttttattttatttattatc       130550
cttttacctagctgaatggcaaaactcagttcagttatctttgggcatggaaaaatgagcactctcacag       130620
tttgctagttggaggaagaattgaagtagagtttagaagacattgggtattatacaacaaaatttagaa       130690
agagacccactttactcctctggaagcattttttgcttccaggaatctatcttacagatatatacacaaag       130760
atatatgtacataggtgatcattgcaactgaaatttttctcatcaggaagatgagtgaattatttaagc       130830
acttagaatattaaaactatctttcccttgaaattgaagaggcagagcaaatgtgaggacacagagtaa       130900
tattcacataaactccttaaacctatgtatgcacgtatagatacttgtatatatacatagatatgaatgc       130970
acaatagtatccatacacatatgtgtacatatgtgtgcatgtgggtgaatgcttatgtgtagattttgtat       131040
acaaatgtgtgtatgttgctgtattaaaaaagtcaaaaaataaacaaattattaacaatgtttgcctct       131110
tagaaggtgactatggtacggtgcccttagagagaggctttgattggcagagaaaatgaaaaaccataac       131180
tgcacctatatttaagatttaaaaaattctttgtagtgagtttgagtaacttttaaaagtacattgaca       131250
tttcatttatgcagatcttctaggtgtgtataaaaagccatgagaaaagatgatttcatgtgatagaga       131320
aaactagcacaggttagaatttggactcagctgatgagacagtatctgcccaaaccaatttaatcaaagc       131390
tttgttgcatgagccgggtgtggtgagtcacacctgtgactgcagcgctttgggagaccgaggagtgagg       131460
atcacttgaggccaggagttcaagaccaggctgggcaacataatgagatcccttctctacaaaaagttta       131530
aaaaatctagccaggcgtggtgactcaggcctgtggtctcagctactcagaagactgaggtgggagggtt       131600
gcatgagcccatgagtttgaggctgcagtgagctatgatcacaccactacactccagcctgggggacaga       131670
acaagaccccgtccttaaaaaaaatttgttttaaacacttcattgtgtggaagaaagctgtatatttaaac       131740
aaatataaccaaacccgtaactactggggagaaagattgatggattgttgaaaggattatacccgttaggc       131810
caattttgagatgtaggcaaggaatctcagaagttccaaaaagttctgctgtggttcagtgttacaggga       131880
aatctactcaagggaataatatatggcttgcaatcattttgcttttttgttacatttcctattattcatt       131950
gcttcattgggcttgagagaagccccacagaggaataagaaatacccctacatcattcacatcttcttggc       132020
ttttgaaaattaaattttatacttaaaagcagccatgacacatgaaaacatttcttttcttcctcaaa       132090
ccatctttacctagcctcacccaaaccaaactttaattttttacattaattttttcttttccaaagctatgc       132160
agctgacactcatctgctcacttggcataattcatttggtatccagtaagtttaagaaattctgtctggg       132230
cttcatgcaatcataacctacatccaaatagcaacacttataataacagtaataatagtatttttttagtg       132300
ttcacatggattttctcccttaattttcatgacatctcaacaaaatagacaaaatacatgggcttctcct       132370
cagccctgagctttgcctatcgttaacccctttgaagaaaaatggcgctgagctatcagtcagtcattcc       132440
tggcagaaagggaacagaatcagtatagatggctttctgaagacattgacttgattctgtcaccaacaa       132510
tggcatattcaggctgtgctccatgccaggtgccgtgtgggcatggagtccaccacaccagggaattct       132580
cagaagcagtattgaaaacacataggaaagcattacttaagcctgtataaacataagctctgtccagaca       132650
tggaatacagtgggagttcttcctaggataatcccaaaactaatacatcagaaagcttacctataacat       132720
gagaattcaaggcaaaggcattttttggtatgtaagtaaaatattaggttgaatccatctcttaatgcgga       132790
tgttgaagaattaatgttatatccatgaagccagtgttgactggaaggactcaaaaaaatctgaagaata       132860
taaattccttgaccttctttattgaagacttcagctccattacacgaccacctcacagtcctcattcggt       132930
tgccttttgcctgtttctgacttactgaaggacaatggtgtggagctacgatttatcacccagaaaatga       133000
ttactaaagtccgtattctactctgaatactgaaaactgaatgaccctaacctaaacctcctct           133070
tcttctggctatcacttcttccttcccactttgatcactcttccatgaatcctggcaaacctcctagtac       133140
tgagtatccttccagccaccaaacgtctgacatagatcgctggatctgactttaattctctcactaagac       133210
cctcaatttcctcctctgcttgtggtgggctcaccctgttgtttctcagctaagggtgcatccagatatc       133280
aatttcttgtgtcccatagcactgctagcattaagtgaattactgcatggtttggtctcattagtgtgtg       133350
gtttccagaaacacttgagatcttactgttggcttgtaatctgtcttagtccattttgtgctgctataac       133420
agaatacctgaaactgggttgtaaaacatataaatttatttctcctagttccagaggctggcaagtccaa       133490
gatcaaggcaccatgatctggcaagaccttcttgaacatcatcaaatggcagaagggcaaagagcttaag       133560
agagtgaaccactcctgcaagccctttttataattacactcatctgttcatgagggcagagcctttgtt       133630
acctaaacacctgccattgtcccctctcctgcaacactgtcttactagggtttaataatattcatgtcaa       133700
cgcatgaattcggggaacacattcacaccataggacaaaccattacactctctcctcatcggggtcaaa       133770
gggcatcaatttaaggttttttgacctttttgttttcattatatctcattttttatactaacagattcat       133840
ttgttcgtataactctcctgtcttccagaatctgggacagttttccacctcccaagtgggatctaggagt       133910
taaccccccaccatcaacccaagtactcctcctgtgtccaatggccagtcagcctcaatcctgtcttctct       133980
tgagttatgacatatttttctccttccattaatagtgaccattactgtaataggaatttatagttctttg       134050
tcctccagttctccaaaactggttctctatcctttcaatttttatgctaacaaatctcattaaagtatgac       134120
cagtgatttctacattgccaaaacccagtggtgtcttttagtgatgatcctatatcaatttgatgggca       134190
ctttatcacttgcagaattcttattcctttcatttttcatcactatgttctggttttattctacaattgtg       134260
agaagctcttctgtattttcttctcttattattcttaaatgttgacttttcctaggatttgttcttgact       134330
tcattctgtatattgtatgtctaggtaattcattgcatcttcttatcttcaactatctgcctctatgtgg       134400
atgattctcaagtctttatttccagctcaggccactagcttcagttacagtgttttgtaatttttagcccct       134470
attagaaatctctagttgagtgtcacatagacactccaaacaacacattcaaatattaagagatgctc       134540
ttcctctaaacctattcctctctgcaccctcctgttagtaaaggtgccccatataccagtgtgtccaa       134610
gatacaaactctgttggatttttacttctctttttctcagcacttatgtaaatggatgtctacttctcattt       134680
ctgccctgcagaacattcctagctatgtgctgtcttcctgtggcccactgtgacagcttccttatctcag       134750
tttagattgttatgcagtccattactcttctgcctcctaccttcaagctactattggagtcatcttcctg       134820
attctcacatctcgatggctttcagtggctaagtgatgcattccaatcttcttagttcattttatgctgc       134890
tacaacaaaacacctgaaactgggttataaaaaatagaaatgtatttctcatagttctagaggctgggaa       134960
```

FIGURE 8A-30

```
gtccaggatcaaggcaccatcatctggcaagaccatttTgcacatcatcaaatggcacaggggcaaagag        135030
ctcaagagagtgaacccactcctgcaagccgttaaaaacgcatcatgggccgggcgcggtggctcacgcc        135100
tgtaatcccagcactttgggaggctgaggcaggcggatcatgaggtcaggagatcaagaccatcctggct        135170
aacacggtgaaacccgtctctactaaaaatacaaaaaattagccgggcgaggtggcgggcacctgtagt        135240
cccagctactcgggaggctgaggcaggagaatggcgtgaacccaggggggcggagcctgcagtgagccga        135310
gattgcgccaccgcactccagcctgggcgacagcgagactccgtctcaaaaaaaaaaaaaaaaaaaaga        135380
aaaaaacgcatcatggcaaaatctctttttttaccacctgggaaaacctaagaccctTgggacagcacag        135450
aagactccttaatctgcccatgtgtcccttccagtgttagcttcttttactttttcttgtacaccctcgt        135520
gcccttgccccttggaacaaacagctcacagttccctcagcacacccaccctTctacctgcccgggagct        135590
gccttccgataagttgtatctcgatgacttcctccccactctccatctgggaagatcccagtcattcatt        135660
tgttaaggcccagtgaaaaagattttatttattttccttcatataatattTttatgtatacatatatatg        135730
catatgtatgctatctatctattagatacatcttgttttggcttattttTattTtttatgttttgagaca        135800
gagtctcagtctgtcacccaggctggattgcagtggcatgatcacagctcactgcaacctcgacctcctg        135870
ggctcaagcaatcctcccacctcagcctcccgagtatctgggactacaggtgcataccaccatgcccagc        135940
taatttttgtattttttttttTgtggagacacagtcccactatattgcccaggctgttTttgaattcctg        136010
ggctcaagcaatccacctgcgtcagccttctatagtgctgggattgcatgcctgtgccctgtgtctgac        136080
gttatccttgttattttaatgcctacctcatttgtcttTttcaaataataatcaacaaatgatttctgga        136150
ttgataaatgcatgaatgaaatgatagtttgccaaaatacagaatattaaaaccataGggtaacctTgag        136220
acaatttaggtaaaaaataggggattatttTatatTagaagattattcaatgtattattaaaatgtttgt        136290
ttattgcatgtgttTtaagtgttgagaatttaacagagaacgagacatgaatggtctaagtgtttatgca        136360
tcataataaagttgaagaaatgtagggttcccatggtgtttctttTcaaactTtgataataacacttctt        136430
tattgatcgcaactgtacattggcagcaccgcctccagactggaaaataagatcgatttctcctttgtgt        136500
ttcttttataaccttgcaatttTattcctcttgggcttactgtTatgagtttggtttctagtttctagag        136570
catgagttctaagaagtggaaatcaagatggaaggaagttactatagtgagagggtgtcatgccctgcag        136640
gctaggtatcttagagtctgactgcaactcccttgacacaggcagttcttttTcttgcctgcagcccttT        136710
ccaaacaaatatcaccagcctcatattcccctcccctTtatagatggagcccctTtgtcaagcaggccag        136780
tttactgggaaaaggcccttctcagacatgctttctcatcctgatgctttgcctttaccaggagtgaggc        136850
cagaaccttcagcatgcatttatatcaaaaaagagagatgtgctgttTtcatttaaattccgcattTcca        136920
ctgggcatagtggctcatgcctgtaatcccagcactttgggaggctagggcaggaaaatcgcttgagacc        136990
aggagatcatgaccagcccaggcaacataatgagaccccgtctctacaattttttTttgagaaaggtctc        137060
agtctgtcacccaggctggattgcagtggcatgtccacagctccctgcagcctcaacctcctaggctcaa        137130
gcaatcctcccacctcagcctctggagtagcttggaccacaggtgtgcaccaccatgcctggataatTtt        137200
tgtttttTggtagagacaggGtttTgccatgtTggtcttgaactcctgacctcaggtgatc        137270
tgcctgccttggcctcccaaagtgctgggattacaggtgcgaatcactgcgctcagcctctataattTtt        137340
tttTttTtaattagtgtgctagtagtctcagctacttagaaggctgaagcagaaggattgcctgagcccag        137410
gagtttgaggatacaatgagccatgatcacattccaccctgggtgacatagtgagacgctgtctctatta        137480
aaaaaataaataaacaaattataaattTttcacatagtcgtaaacctctgaagatgtggatacttcattTg        137550
tcacatttaggtctttaatacactaataccttctcttgggaaacagtgtttTctcagtctctcccgtattg        137620
ataatgtttccactttgcccttgaagattttgtgggttatgggGaaacagttTatggggtgtctttcagc        137690
agaaccacaacccttttTaggaagaagctaattatggtgtgaaagggacaggtgctcttattaggtagtg        137760
atagtaagagttaaaacccagttctcttgagctgttacttGgattcttcaactgagggtgattTtgcatc        137830
tttggcactagatgtcattcaactgacagtcatggactcccaggggaccccccaaactctatgtcacctTt        137900
atgagtaggcgagaatggattttTtcttggagaggagtgtctcctcaaagaagtctgtgacctagaagaaa        137970
agatgaaaaatctctgctttTggattcggaatgtcaggactgttcacttggaactTaaggagagtttcttc        138040
ctagtatatacgagactgaaccttatggggttgccattTtcttagacccaaagctttcaaatacagtcat        138110
tttcatatgacttctacttagacaataagatcatcatgtattccttttttCctctttcagcatctggcat        138180
ttTtctcctcttgggcttgttgttctggttTtttttttttTtctggttTtctagaccataagcattcatgc        138250
attcacattatgtgcctcctaagttgtaagctctccaaagagagggaatatagctgcttTtatgtcttca        138320
cccaactttgagtagagatgatggcaggaaacagagagcattttcacagagaagatggagtccatttgag        138390
tcagggGatcttgtttgaaatcttacctgtgtgatcggggtgaattaatacagctgtctggaaaatttTa        138460
gaacagagaccctcagaggattgcagtaaggagtcctagaagttaggatctcctcagtaaaatataaatact        138530
tattctcttgggtaatgaagctgacccacaggatgatgccaattatttccttgtattataagcacataa        138600
acaatagttcacatttattgagtgcttactatgtgtaagatacaattatgtgcttTgggatatgggttca        138670
cacatgaaacaagtgtttatttagtgcctactctgtgcccaacactggagatgcagctgtcatgagcact        138740
aacaccatcccaatatcatggtgctcatgtacccatgtgggaaaagtaaagacaggctcaagcatataa        138810
aatagggaaggtggtcttaggataattcaagctggattgggatcagtagtgattgaagggctagattaaa        138880
tgaggagtttaggacatgcatctctgcaagatggcatttgagcaagaaacataggcaagacttatctact        138950
ttaattttcacagtaggtgtcatgagattacactgttttaactctgttacagagatgtggaaactgaga        139020
ttaggatgattgaataacagccagattagtaataGggctggtagtcttTaatgcaagtctcatgggctat        139090
gctgcacacagtcttaacaacttgccaccttccgtggtataagagaggaaccaacccaattcccgttgcc        139160
tgccttccctgctatattagtctattcttacactgctataaaaaatacctgagactgggtaatTtataaa        139230
ggaagaggtttaattgactcacagttccgcatagctgggaaggcctcaggaaatttacaatcatggcaa        139300
aggtgaaagggaaggaaagcaccttcttcacagggcaggagatacaggagaagtgctgagcaaggaggaa        139370
gaaccccatataaaccatcagatctcatgagaactcactcgctatcatgagaacatcgtgggggaactg        139440
tcctcatgatcTaatcaccccccatgaggtccctccccaacacgtggggattacaatttggattacaat        139510
tcaagatgagatttgggtggagacacagagccagaccatatcacttgccatctaattaccttgatcaact        139580
accctgcaaccattccttagtgagtaataGggccacactcaggatggttttaatagaattTaaaagtta        139650
tcagtattgtgtttaattgtaatttTaaaaatggtgaacctcacatcagtggctaggatcagcacatga        139720
tatgctgcatcttgggGtcaataattgccgcaagcacattattagagttgctgttaatagtcatggaaac        139790
caccctgtaccttcttccccagtgcaaccaacctggcagtgattgacctactcggtagcgagttgctag        139860
acatcaggagaagtcagaagtaagtggaagaaggccaggtgtctagaagaccccccactacccatagca        139930
gtagcaacacatatgcataggaataggttaaatgagtcttcactcattgatccattcattcatctttcat        140000
ccatgaattaactattcatgacccattgttgttgactctgaagatacgatagcaaacaggatgcacaaat        140070
```

```
tgtcctgctgttactttagttatggggacagaagataaagcagtgatcaaatgcatgaaggacagaattg     140140
ctgatggtgatcatagctttgagggaaatgaagcaacgataacatctaatgtgggttatgaggatctttg     140210
agatggagtggccagggcatgtctcttatgagggtgaggaatttaagcatcccagacacaagttctgactc     140280
aaacatcagcctttaattatgtgaaagggtctcgcaaaatttaataaacttagtggtaggagttcaggt       140350
aacactacaagaaaccaagctttctttgtgaatggtgaggttagaaggggtttgttgctgaaaatcccat     140420
ttgcaggttctaaggctggggatgaagtagaaggaacaatctcttgtcatttgccaatcaaagaacaatc     140490
cctgtatctggcaaaagagacatacctttctatgaatcctggttttggtcataagccaaacttctatatt     140560
agttttcccttttggttgagttagtgaacaattggatgattagctaaatgttgctgaaataggaggaag       140630
gcagattaaaaatacagaaagtaactcttatttaatgatttgaaaaaatgaggttaatccgacaaaattt     140700
taaggaaaagtgagataattttggtgtataaaactatgaaattttaggctgggcatggtggctgacacct     140770
gtagtcatagcactttgggaagctgaggcaggaggattgcttgaccccaggagttcgagaccagcctggg     140840
caacatagtgaaaccccgtctctacaaaaattacagaaattagctaggcatcctggtgtgtgcctatggt     140910
cccagctatgagggaggctgaggcaaggagaattgcttgaacctgagagttcaaggcctcggtgcactct     140980
gtcctggcttgtagagtgagaccctgtcacacacacacacaccacacacacacacagacacacacaca       141050
cacacacacacacaaaataaaattttggaatgtaataacattgatgctgaagtgaattgtggaaaaatat     141120
catataaaatatattttaatcacatagtataaatttctctctgtgcattagttaccaaaatttgaacata     141190
aacattttcaaatacacacttgtgcaaatgtcagggatagcaggtggtatatcacttttttatatttaaaa   141260
tgcatgtaggaatgaaaggaaaaaggtaaaaatatgttaagtgtagaattctaatgaaagaacatattgg     141330
aactatgaaaacattatggaggactttgttcatttatggtctgagcacagatgatgctaaacatggtcct     141400
tcaactttagctggcagccatttgaaatgaacacactaaacaccatgagaagcaactgcatgaaaagcaa     141470
agagagttatccaagtgaacttcatatctcatcatttgcctgtgtttatgtaatagtaaagacccaagga     141540
attggtctaattaattggtattttatttagtgatgaaataatgagtgcggttgagcatgccagatgtat       141610
tcatctgatacattcttccagtcacatggtaggctgcattaggtgatatgcttcaccctgcattcattt       141680
ataagttagtgaagggaagtccacaactctggtctcagagcatttatcccattgttgatcagctaagctg     141750
ttgctcttacttagctgctaaggaatgaagctaattggaccattccagcatgtaaaatatgtaaaatatg     141820
tcctttcatggaactctgaaacaaacaatgagaacaaccagaaaaattgccagagtcatacaaaagctgt     141890
ctatttctaaatgatcattcctcaagctcttgtcatctactgggagcccctagatggatgtatagttgtt   141960
gctgttgtggctgattttgataggactaacatagaccagtgtattgagtcgtgtttattaagatgcttttg   142030
ttgctgagtatttacatttttgggtgttctcggataacatacgttaattcctactgcagtatttaataaag   142100
tgtaactagtgcctgtctcacctgtctgaagacattcaaatatggagcgtttgtttctttctctagtgca     142170
gatactaaatatcatattgtaattagagctatacagagatttagcataggactggcaagtcttggagg     142240
ccaatttttatgatgtgggaagagggggcgtgatttagagtggacaaataaagtgtgggaaaatttgt     142310
gtttctggcttgagtgaccagctcttacctctctccccatattctcttcctgcctcagtgcaaattca       142380
cactgtcttcattttgtatgatcaccctctgtcttagtccatttagttttgcaattaaggaatctctgag     142450
actgggtgacatatagaggaaagagatttatttggctatgattctgcaggctgtacatgaatcacggcat     142520
caggatctgcttctggtgagggtgtcaggaagcttccactcatggtggaaggtgaagaagagctggtgta     142590
tgcaaagatcacgtgcaagagaagaagcaagagaatgggggaaggaggtgctaggctcttttaaacag       142660
tcagctcttgggaatgaacagagcaagaattcagtcattactgccaaggctggcaccaagctgctcatg     142730
agggatccacctccatgactcaaacacctcccactaggcttcatctccaacattgggaatcaaatgtcag     142800
cttgatacttggagaggacaaacatccaaactatagcactctgtctccttaggtgcacctttcttcttca     142870
gtgactaatctagagttctctttgaaaatgcaaatgtagttatgtttcttttttgctttatgccttac       142940
tggttccctgttctttatagcatcaggttgcatcttcatcaactggggaaccagttgatgaagagaagat     143010
cagcatcctgaagtatcttgtaacttcttgaagtatcttcaagattcagaatgcatgtta               143080
ccttctctgcaaagtgctctttgcaccttgtccagtgtagctgtgttaactccagtgcaccttcctgatg     143150
atcttcctaaggctcttaccttcttgtcattagtcgtttctgtgaccatcttgcctataggaatgtgggc     143220
tactgtgggcaagtacaatgcctggcatgcagcaggcttccagaaatgcttgtttggcttctagagttc     143290
tctttgctgttaccacatccatcccttatcatcctttttccctagtcatctttcctctgtaccttgc       143360
cgttggttctttctccatgaatcaatataaataacaagctttgtcatagcagaccttcactcttgtc       143430
tcatgatttcatttctttcttcggcatactgaaaggcaagtacctttctctctctgactctcaatttact     143500
catctgtataattttgatggttcttttcaattgtctgctattgctgatgatggcacgaactcagatatgca     143570
aagtatcagactttcactcttgtctcatgatttcattgcttcttctgcatacttaaaggccattacctt     143640
cctctctatgactctcaagttcctcatctgtataattttgatagttgtttctactgcctgccattgctac     143710
gacaatggcacaaactcagatatgcaaagtacctctgggttaaatgtgaacaaaaaccttcaacctgctgc     143780
aagataatctgacctctgcttgactgtctagctctgtttttcctggcagttggatgaagaacatggcaaca     143850
atattcttggccacattgcttacaatacaaacgatcccctatttgtaaatagcatcatgaccaggagaaa     143920
ccataaagacctgaaagaacctagtggtaataccaccccacctcaggcttcccggagggcaagttttgga   143990
gtcactttgcagctgctctgttcactctaggaaccatggaaactctgctcatggagtatttacagggaat     144060
attggctgctgtgaagctgggacttcaatgcaaggaataccaattcccgtggatggatgaccttgtag     144130
ggatctttgcatctcagctgtcctttgtggagcagatggttcccatatgcctgctgcagccttcctgatg     144200
agctgagcttcttgtctgtattgttttgagtcggttggcaccatggtaactttgggggggtcttgtgatt   144270
ctgcatgtttaatggaacctgagaagacccttactgggcattaaagaacaaagacaaatgtccctgtgac     144340
agaatactggctcaacaattggttttctctctgatgcctcttccctgcttggaaagcccttttcttttat     144410
ccttcataatcacttcttacatctggcacagccttcagctttgcattattccttcattatcttttctcat     144480
cccacattaaaaaaaaattcttttaaattgtggccaaatgaacatgacataaaatgtaccattttcacatg     144550
gcagttcaagagtattaagtacattcacattgttgtgcaaacatgcttttttttcactctgtgccctcatt     144620
ttgctcttttcctggtttccaatgcagtatcttatatatgatctaataaatgtgtcctgggcatctcagtc     144690
ttgtatattttggtcctctgttatatcaggtacaccttaaggatagacattgtgccctactaatcttcct     144760
ccttcatcacatgaaatattgtgcttgcatagtacatttttcttcactccctccctgttattttttatgt     144830
atatcatgacacttatttgccaaggatggctttggccctctatgcaaaatgtcaccaatgggaacaatgc     144900
taaagtctgcataaatcttaagtttaattctaattttaaatatttgaatatagtgctagtgttgtcattc     144970
tataggattcattaattcatcccatcaacaaacacttattgagttccaaatttgttcaaaacatggccgt     145040
atgtgctgctgtagaaaaaatgtaaaaagtcagtttctagtgtaagggaaataaaatatggatatcatta     145110
agtcctggagaaggcaggggtgactgatttcaggcttgtaccatagggattcccaggaggaataagtag     145180
```

FIGURE 8A-32

```
gttgcagcatttaagaagggatcatgaaagacatgccactttaactagttccaaatggaattttggaagc      145250
agagccattggatgttatagctgaagtaatattttaagcaaggtgtcagaacaggattgaggcataattt      145320
cagaagaacatgaagtccttgtttactaatgcagaatatgttttatgataggctggaaagtgaatctgtg      145390
actagatttgggagtgattcagtgtacaatgaatatggcagtaaagagcttggacttaattcgggctgct      145460
ggtctggtcagcccttgtgtttggagagatgagtaacatttgcaaggtggagagaaggaattggagatt      145530
ctagttaggtgctttgggcatatgttcagtgagggatgaggcattaatgttcatcaaggcagcattcaca      145600
agggctatggcggcactgaatgggagagcagacagacacaggtgtcatcccagaggtggactccgtatgg      145670
cacagcggcaagggagtgtgaagggttatgacagatgctgagtaggtgctagcaacatattttttaaaat      145740
agtggcaaaatgtatgtaagatctataattttttgcatgtacagtttagggatattaacaatattcacact      145810
gttgtgcaaacatgcttttttcactctgtcctcattttactctttcctcatttacagtgcagtatcttat      145880
atatgatctaataactgtccctaagcatctcagtcttgtatattttggcccactgttctatcacgtaca      145950
ctttgaggggcattttcagataattccaggtaaaacgtaaacctcacgatggcagctaagaaaacaggg      146020
gcgttctctgcattggttagttgcagggctattagtcaaaattccaaatctcatatgcagaaggccagga      146090
tctgcagtcttaagtagttcagtttgtttcacggaggtaaataaaagaaaaaaggcatgctgaagataca      146160
tatccctggcctctagataatcagacagtaagatctctcccacacaccagagaaatctatttccagcttt      146230
ctgttgcagtccatgaaaatgacagaaaatacatgccctgcttggaccacagcctagctcatgggaaaaa      146300
aaaggaaaataaaaaagaacccgagcttgctgtggatggttcctatggagtgttttttggcactgtcagag      146370
tgcacactctgacaggctgggcatggtggctgacacctgtagtcgtagcactccatggcactgaatttac      146440
ggtggaaggatcacattggcaagtcaaatccttgggctacaggaaagactcccatgtgctgcttttatgc      146510
tccccagcagccaggctgtcgttcacaaagcactctccaagcatcttcatttaatgttgttgggcacaag      146580
gccctggtgaccccgttaaaatttaaatcttgctcatacaaagtgagggcaggttttcagttgacatttg      146650
gaggtttctccagccatgttagaaacaaaatgcatttaagtgaggccctgatcataagaaggtgta      146720
gagccagctggatttctccgggaccatgagggatccatctgattagggcttctgaagccgaaggaaact      146790
acagagagatgtaacttggctgactctcagttcattatttctcttggtaagagcacttctcatattgga      146860
caatctttctcttcactgatttagatattattttagatgcaccttttcttttgttatggaagctttatt      146930
taaaataaagttaacctaaaatgggcgtattactctcccccgccccaccgctaatgatttagaaacatga      147000
aaataatccacaagaccatgggtgctgtcttcagctacaattactacttttcttaattgtcatggaaacat      147070
gatttattattggatggttttttactgtcttatgcaaagatttcatatgagccgcaatacacactgtttc      147140
atatgggtaagtctcaatattatctgacaaagagagcttctctgcccaagtttatgaaaagtacatttttt      147210
ttttaagtcactgtcttgcccaggctgcagtgcagtggtaccatcatagctcactgcagcctcaacctcc      147280
tgggctcaagcagtccgctcacctcagcttccttagtagctaggtgttttggtttggcttttatccca      147350
cttgaatatcatcttgaattgtaatccccagatgttgagggagaatctggcgggagatgattggatcat      147420
gggggtggtctccttattctgttctaatgatagtgagtgagttctcacgagatctgatggttttaaaag      147490
tgtctggcaggttcctccttcgcacattcttctctctcttcccaccatgtgaaaaaggtccttgcttcca      147560
tcccgccacccttctgccatgcttgtaagtttcctgaggcccccatgccatgcggaggtcaattaaacct      147630
cttttccttcttaaattacccagtctcgggtatttatttatagaagtgtgaaaacaaactaggacactagg      147700
actacaggcacatgccatcacggccagctagtttatgtttatttttttaattttttgtagagatgggtctc      147770
actatgttgctcaggctagtctcaaacttttggccttgagcagtctttccacctagacctcccaaagtgt      147840
tgggattacaggcatgatccactgcacctggctgaaaagtttctattgaatggaaagaacaatgctgtga      147910
aaatatattttattaatgttcaggaaattgtggaacttgaaaaactctagcttttagcagttttaatgg      147980
ctactatgtgcttctaaaatttgtacctgcttttttgaagtgttatatgcatttttgtttgttgatggtg      148050
gtgatgtttttgccgttgatctcacctgctaacgtggaaacattcaagaagtggaaaaatgtcttattt      148120
tagtacatactatgtgtcagctacattaaaaaaaaaagccttaaagaatgtagcttgaattgagggttg      148190
ctatgacttttgttgtagtagatttatgaattgtgtatcatcattttccttcagtggaaaattcagtaa      148260
ctagtatgttactggttcctggattccaagggaggagaacatgaaacattgcaatggaattaaactccaa      148330
tgagcttgacccagctacgatgttgaagtgagggaatacataaagacttgggtgtatgtgtgtgatctgt      148400
tggtattaaagtgccaggattacaacattctatgaaaatggctaatcatattcaatatttatttgagacg      148470
cttaagatgcatggtttgggtggaactagggttaggggctgctgttttgaacagccaaactagaattct      148540
gctcaattatctcacacaggcacacttctgaggcattttttacatgatgcctcaagaaagctttgctcca      148610
ttttgtatttcagcatgaatacaaattttttgaaatttccacagtaaagtgtttagacttaccaaaaggta      148680
ggccttgttataataacaccagtaggaccgatgtagtcatttctaaaatgattcaagcactttatgtttc      148750
tggatgagctattagatcttacttatgtgtctggataagctattgatcattacatattttaaagtgaa      148820
ttttgaaattgttggttcattgtttaaattttcaatttgtttctgttgcattaatctctgagatttga      148890
aaatgagaaagaaaaaagatggatacacattaatgcttttataccttcctttgtaacagcaattgattg      148960
tgcacttgcttttggctgtagtagtcctttcttaaattagtttctggtatggatgtctacttttattt      149030
aatttttttttttttgagacggagtcttgctctgtcaccctggctagagtgcagtggcgcgatctcgg      149100
ctcactgcaagctccacccccgaggttcaagcaattctcctgcctcagccagctgagtagctgggactac      149170
aggcacctgccaccacgccaggctaacttttgtatttttagtaaagacggggtttcactgtgttagcag      149240
gatggtctcaatctcctgacctcttgatccacccgcctcagtctcccaaagtgctgggattacaggcgtg      149310
agccaccgtacccggcccacttttatttaatttttattcaattttacattttatatgccttgttacttc      149380
atttcttagcaccagaactacaagtttaattcttcagacatcttctctagcacctcataaggtattcttt      149450
gttacttggtgatagagaactatgtaatttgattttcttcttgcaatggagtgttcaaatacgttgaa      149520
gctttaggtgagggatgtgattaattagaaaatgagtggatcttagctcaatgaaatttaatcagcag      149590
aatggaattttccattcagagcaaatgagttcctaggactggacacacctagatctgctgacccaaaacc      149660
ctttatagatttcatttctgaatgagctattagatcattgtatattttcaggtgaattttacaattgtt      149730
gattcatcgtttaattttagtttatttctgttgcattaatctctgagatttgacatatagaagaaac      149800
tctcatgccagccccaaacgctttccctatctcctcctcccatgcctccctgagtgggagggaacgtcag      149870
gcataagcagagcccaggagacactcatagacattctgagaaagctttctctgtagaaggggaccaacac      149940
atcttgcaccctctccctctcttgcccctgcctgcatgtgggtgcaggtgcttttgtcaggaccccact      150010
gcttatctcagctcaggagctggcaaacctatgaacaagatggaaacccaactgctgaccagggtggtgt      150080
tctgacaggagagaagacttgagcccttatagacactgttgaatcactaagctgtaaacaattttcttg      150150
gtcttcttgtctggtaaaatcaattctcttcatccttttaaagacctcagtttgggctttagaatcca      150220
tactggcaaatgcttcctcactaatattgtgagatttaattagagatagcattttatgtgctcacctaaa      150290
```

FIGURE 8A-33

```
actatacggtagacacaaaggagtctgggtctcagatcccaacacgtggattatagagaaggcagaatgc        150360
tataatgccttgagggtgagccatccattatttgggatttgaaaaaggacaatttctgttttatgtttc        150430
tgtcctcctaaatggagttgagagacagcttcttttctccttagcatttgggcaagaacagaatccagta        150500
aaaccactgaggaaggtcatcattgcagcgtttatttaacatgagtaattctagcatgagctggcatgcc        150570
atttacatccatctgttttaagtgtttgcaagcagaatggtaataagaaactggggtaagtgttaaaaat        150640
aattatatggaatatagattgccccagatgcactatctaatgctgatgggaaaggagagagcaggggta        150710
cctggaacctggacttctccttggaaacatgccatgaccgggtatgttactggattgcataggtgcagaa        150780
catggaacattgcagtggaattgaactccaatgagctcagcccaactacgatattggagtgaggaatgca        150850
tgaagacaaaacctttattataagtctgtgtgtgtgtgtgtgatctgttgggattaaagtgccaggat        150920
tacagcattctatgaaaatggtagtggagaaaaggaaaggtagaggaaaagagaaaaaccaaagcaagag        150990
gaaaaccactggaagaaaagaagatgggaaggagaaagggcatctctgaagaatgtaaggagtacaagat        151060
cccttacaggcagtgaacacataagaaggcatcattcaccagaaagtcataccagtttatgtattaaaac        151130
tgggaatggcaatgataggcattagttagagattatgctttaaattgtatgcatttgcatatttttatat        151200
gttttatttaattttgttttgggggggggactgtatctcactctgttgcccaggctgatgtgcagtggta        151270
caatcctagtttactgcaaccttgaactcctgggcttaagtgaccctctccacctcagcctcccaagtagc        151340
tgggactacaggcatgtgctactatgtccaactaattttgttatttttttgtagagacagggtctcaatg        151410
tattgcccaggctggtctggaactcctgggctcaagtgatcctcctgccttggcctcccaaagtgctggg        151480
attacaggcgtgagccactgtgaccagcccttttgcatatttattgttttgtttgtttgtttgttttt        151550
gagacagagtctcactctgtcacccaggctggagtgcaatgacgcgatcttggctcactgcaacctctgc        151620
ctgctgcgttcacgcgattctcctgcctcagcctcccaagtagctgggattacaggtgcccaccaccaaa        151690
cccggctaatttttgtattttagtagagacaggatttcactatgttgggcagactggtctcgaactcc        151760
tgacctcatgatccgcctgcctcatcctcccaaagggctgggattacaggtgtgagccactgtgaccagc        151830
ccatttgcacatttagtgttttattttcttaatcagtatcgaactgtgaaaggaatgttaaaacggtgg        151900
agccaggtgaaaaagaaaatccaagagtcagaagagagcatccaaagaagaaggcagaggcaataacaag        151970
tagactctgagactgaaattaaactgtatggctagaagatgggctagcataggacaagatgaggtaacat        152040
gctaacatggaagattgagaagaattgcaaatgagaaatcacggataaacactgaccgcctaatagat        152110
aaaagcagaggatgttcataagcagctgtcatcaccaaggagaggaaaacatgggaaaggttttgccct        152180
ctgagcagaacaatcctgcatgtcaaggggagcctcatataccatgtaacctcatgttaaaccataaat        152250
acttaccaatacctcttacagtgtgacaggacacaaactattaaacctgatgcagataatgccttttaaa        152320
atgagtattatatttgattattatttctaataatgttataactatgtttaaaccatccactttattccct        152390
agatgaaatataattgaattaaatgttaaacatatttgacatgcatttctcggggcttttgattttaacat        152460
tttaaaatatgcaatttagctcatttttaaaaaacagtcttaaaaaataacatagtatatcaagataggcag        152530
aaggaaaatttaggcaccaaataatagagtacatgtttcctattatgtgttttggttgggagatgatctt        152600
tggaaagtgctgattctgtttttgtttccataaaacaaaatttccagagattatatattggattctgctt        152670
gaaagagttcagtagacattgcacttctatcacactgatagcccaggaggaattttaactatgtaattat        152740
ttaaccgcaaaattttccacctctccccttaaacattttggcggataaatttatgataaaagcagtcatga        152810
tatgcagttcggtttcatagtttccttttcttcctttttgctatatttcctaaagttctattatggaga        152880
gataccagttttaaatgtcaagcaatgttaacatcttttgcatctttatcttttcctatccactcttctct        152950
cttttcttttcttttttttttaagggccagagagtgacacttagccaatacttaaccagtactctctttt        153020
ctgtttgtttgtgggaattttatatctatttttctttttcaattttatttaggttcagagggtacat        153090
gtgcaggtttgttacatgggtaaattgggtgtcgctgggggtttggtgtacagatgattttgtcacgcagg        153160
tagtgagcatagtacctgataggtagttttttgaccctcagcctttcccacccaccacttgaagtaga        153230
cccttgtgtttattgttccccttttgggcccgtgcgtcctcaatgtttagatcccacttgtaagtgaga        153300
atatgcagtacttgcttttctgtttctgcattagttctcttaagataatggcctccagctgcactcttgt        153370
tgcttcaaagaacatgattttgttcttttatggctatatagtattccatgatgtatattacaccacatt        153440
ttctttatccagttcaccgttgatggccatctaggtggattccatgtctttgctgttgtgaatagtctg        153510
tgctgaacatgcaggtgcatgtgtctgtttggtagaatgattttatattccttggatagatatccagtaa        153580
tgagaatgctgggtcgaatggtagcgacttgtctcttaatagtttttactttgcctcgatctcctgattc        153650
tctcccttttttttcctggccattcccgctgcacttgcctcatttgctattgatgacatgcttgtcccctg        153720
cttccatagatgtgtccacaaatgcatgtgcacacgtgcttcagctaaagattcctcagctaaagattct        153790
cctctctcatcagggtttctctctcttagctcacctgccctctctcacatggttttaaagtgagatgattg        153860
taaatgtgttttttcacaatggaaattctcccagcgggcggggaggaaaaaagacatcattgaaatattttc        153930
tgagaactatgaggaccggcagagtttgacatgtttttgaggcgataaagtcatgtgtccatctgtgaaa        154000
gacaggcattgcctttatccacatccacacagcctcccccgctgtgtggcttcattattgatttgctgtc        154070
atgtagagtcgataatgagaaaacctaggtagccttgaacccaactttgcaagaaccttttaggactctg        154140
ggacttctaaccctctaggaaggtggagttaaggggatataggcacagaatggggcagaagggaaagaca        154210
ttaagagacagcctttagcagaccagagaatacatgccgtttatcaaattgttagatgtctgtgccaccag        154280
gaatgttgattcaattatggtatctaaaaataggacagaaaataaggaggaaataaaaggaaatgaaatag        154350
cagtttacctctggcaaaaacaaagagcccaatcagaaaaactagacaaagccacctgtaggactggaag        154420
aaaccatgtgagttaggtatcactaaccttggaaggacaaggacttcctagtattttttgtattttgtgaa        154490
gcactttctctgcattttcttaatttgtccttaagtgattatctctcaaccaaccccaaaatttgactct        154560
tcaaatcatttattctctaagattttttaagcattcaactgtaatggcttatgtatcagcatagtcttata        154630
taattctaaaacaacattcatagcatggtatcttgtaatatttgactttcactattaattcttcagtta        154700
ttatttgagtgcctgtcacatgccaggtattgttctaagcttcagggatgcatccatgtacaaataaat        154770
aaaatttcctcccttgtgccactgatattctataggtggatggaaaacaaacttaagagttaaataaatt        154840
aggttttatttaaagacagggtcttgccctgtcattcaggctgggtgcagtgtttaatcatgctcaccg        154910
tactctccaactcccgggctcaagcagtactctcacatcagcctcccaagtacctaggactacaggtgtt        154980
gccaccatgcccagctatttatttctgtatgtttttcttttgtagagattgggtcttgctatgttgcc        155050
caagctggtctggaactcctaggttcaagcaaccctccctccttggcccctaaattactaggatcacag        155120
acatgagccaccatacgtggccaaagttttgtattattttataaggtgatgagtgctgtgaagaaaacta        155190
gaagaggataagtggaattagaattgctagggaagttgcagtattttaagtagggtggtcaatgacaacc        155260
tcaatgaaaaggggatgtgggagtagagaattgaaatagctcagggaaaagccatgatgatatatgaga        155330
aggatgttccaggcagagggaacagccagtgccaaggctctggggtaggaacatccctgttctgtttagg        155400
```

FIGURE 8A-34

```
gcagagcagtgtattagtctgttctcaagctgccaataaagatatgctcaagacttgggaatttataaag   155470
gaaagagtttttagtggactcacagttccacatggttggggaggccttacaatcatagcagagggcaagga   155540
ggagcaaagtcatgtcttacatggatggcagcaggcaagaggagcgtgtgcagtcccttttacaaaacca   155610
tcaggttttgtgatacttactcactatcaccagaacagcatgggaaagacacaccccccatgattcagtta   155680
cctcccatcaggtccctcccacgattatgagagctacaatttaagatgagatttgggtggggacacagcc   155750
aaaccatatcaagcagtaagatccacatttctagagtatcagagtatgccatcagaatggcaggtatcag   155820
agtagggtggtgctatcgagaactttgtaattctgagaaccagggagaacaaatggaaggatttcaacag   155890
ataattcatgtgtcaaggtgtgttttaaaggagcactttgctctagctgaggcttgtctgtagggggcaaag   155960
gtggaatgtgggagaccagttagaaggctgatgtaagagtcaagataagaacctacagctgggaggtgag   156030
aagtggttggagttttttatacatttgaagtaagatttgctagttatatggatgtggagtgtgggagatc   156100
gaaggaagtccagagttttttggcctaaacactggaaaaggtagaggtggtcacaggtgacattggaggat   156170
gggctagtagagacattcttaagttatcatcaaagtttaaatgtttgagtttgaaatgtctatgagacat   156240
caaacggaagatatcccataaggagatggatgtcagagtctgaagttcaaggcagaaatctgtgctgaag   156310
agaaaaaatgtcagcctagatagtgtcgatggtatctaaagctatgaggcggaataaaattatcaagaga   156380
gttctgtggacagagaagagaaaggaccaaggctggagcttgccaacaatttgagattggtaataatacg   156450
aggaacctggaaaggaaatgaacataattgtccagggtgtaaaagaaagtctggtaatgtggaagtgaag   156520
gggggaaaaaggcatttcaatgacagagaggtagtcaactgggtgtaattcaaataggtcataaaatgca   156590
catctgctgctatggtttccactacagatgcaaggaaaaagtgtcctcgtccttttgtctgtctgattgt   156660
ggcagttgagattgaatagaggtagacagaggggaaaaaagaatgaggaaaattgagaacatagcaatgc   156730
aaatgtcattttgtgacctttagtagaaaagtaataattttggtggagtgttggggtaaaagccccaatt   156800
ggggcaggttcagagagaataagagcaataaaattggaatcaatatcaataaatattttcaaggatatt   156870
ttcagaaaaggaacaatatagacacactttttttttttaagatgagaaaattgttttattgcttttaagat   156940
ggaaaatctaaccacatttctgtgtgctgtagggttgattctagaggcgtggtgttatcaatcagtacagt   157010
gtatagtgtgctacattaacaaatatccctaaaatggcagcgacatccacagccactaaagttgatttct   157080
cgctcatgttcaaagttcgctaaggggttgactgtggctgttttctgtgtattcttaattctgggacccgg   157150
gctgatggagaagactcatttattcttattattactaattattttttgttattttagcaaaggggggaaaat   157220
gggcagaaccacattatagctcttaaggttttcgcttggaagtagccccactaatttctgttcatgtttc   157290
atctgccaaagcaagtcaattagctataactggaagtgagtcagtgaaattctttcgagtta   157360
gggacagggaaagtcttgcaagtgtgtatttgtccccttgagaggtgtggacagtttttttacacaataat   157430
acaacatacaagaggaagacaattctgaggatatagcaagagcaaggtgttctattgttgggttgtcaag   157500
agttgatggagtttgatgggtgagagtcagcctatattgggttcctatcattattctcttatgaaaaga   157570
ggaggcacaaaagatggggccattattgtcacatgggtaaatgggttagtggtggtttgtgcatgttttc   157640
ttgagataagaatttcttcagtgtagtaagaagccaggtcatattctaacagtgaagatggagcacgaggg   157710
attggggattagaagaggaagaagaaggtgctatttagcagagcctttaagggaattcatcagagaaatt   157780
tagtatgtatatacaggcatctcgattaacctactggaggttgtgttcatgaatttaatgtgagataagt   157850
cagcatgattaaatatcttctttcatctgtgctgatcagtaaaggtgaggcggatgcatgctgggtgggg   157920
aggtggatttcaccagggttggagttttgccaaggaagaatcaagaattaaggctggattagaattgagg   157990
gtgtctaaaggatcgtggatctgctatgactccacaactctaagaaaagaagattcggtaccaccatcct   158060
cattatggaaataacaaacgaatgaaacaaaaccatttgtcacttttctacaagattcagagggcttgtat   158130
gtctatgatctcaggcctcaaaaagagtaaatcagttacctttttcccacataactctgtgtgtgtgtta   158200
gtacaattttgtatgtttgccctagaatgtgaaccatgaatttgtgaaatgaaagcagtgaataggaaaa   158270
aaggtaaagatacagtttttgtattatctgtagcaaaaatattaccacagctatgtaatccacaaaaatgg   158340
aagaaatttattaggtatttaattttttatccaagagtagtaaaatgaaggcagctatataattatgtagg   158410
tgactgttaaaatattagactttttgttgaaattttttggctcagaaaacaggtttcatgccatgctgaa   158480
aaattacttagtttgatgaaaaagtaaacaagacatgacagtgaaatcatacagtgttgaaacaggaaat   158550
agctaaaatgtatttttctcagtaaataagtggctggcataagttgtcctcattttggggtcaagatctt   158620
attttggtgtctcagctgaagatgacctcttcacaatccattaggtattgtgacactgattaattattat   158690
caagcagaaagtattttttggaagttcttgacattgaacttggaggcagtcgctaccacagggggcacag   158760
gtttcgaagcagttcaggaggagccaacgtcttgctgagaaacccaaggcagacagcaattagaggataa   158830
gataatgtataattaactgccaccgtgtgtggggtagacaattagagaacaaggcaacacagatgttgta   158900
aggtgctgattatgggttttaacaataatgaaaaatggaagacaacatcatcagcgtgggctgacgctgt   158970
caggggtggtgtgttttctcatgtgctgttaccctctaatcagtgttgagttggatagtattcccaggaa   159040
tggctgtttggcttcgcttctctcttaccagagaattcctctgcctttataaatgtagagactgacatgtaga   159110
cacacttggatcatgaatttccattctactctacaagaagtacagctgcaaagaaaatcaaatcatgttc   159180
agtacctttctggaattttcccaagtactcagtagtcattctagctcacatcttaactctgctagggttc   159250
aataagtataccaaatgcatattttttttagctaattccaaaatctaattcactttgatcaatagtcat   159320
ctcctatgaattccttgtgttttcttcactataaaatattttgtgattcatcttcagtagacgaaagg   159390
tgaggtacttttgagattatatttctacaaatcatgaatgattcattatttttactgaaagtaaacacatc   159460
catcatattaaatccatatcatgttctgttgtatattgtcacttaagtgttttttattattttttaaacagg   159530
ttgtataattgcatagagcttcaggctatctacatagacaaaatatctgaataaaagtacaacgatcata   159600
tttttatcttgtcagtttaaattatgtttaatgattttaattccaggggaaaactctaatgtaccaagttac   159670
caactgaaatgtgcccagtatcaatcctttatttttaaatataacattgtaagttgttaagtaagttgtt   159740
aactcttatccctaaaaagacataatgtcccttttcttatcatatgctaaaataaaatttctaacaat   159810
gaatgtgccatttttataagccagcaaactatgcaagtaaggatctcaatagaagatttaaacaaaataa   159880
ttatttgctccatattctgttgctttgtttttgatgagataattaattttcatggaattttaaatga   159950
tcaatttgtagtaaattttgggaaatatgtccattatttaatcacagatttagtatcttaaacacattga   160020
caacgtcaaacttgtctgcagcaaatggttactgttaaaaatttgccataggggtgagaactgcaattta   160090
tactatttctaaagcatatcaatgcttcaattattacatgtgttttatatatatatgtgtgatgacatgtg   160160
tgtgtgtgtgtgcatgtatacacaaatttaaagtaatggcttactgaaaggccttttttctcttcata   160230
tgactaagatatctgaaattctgcccaaaattgctaagattatataccttctgaaaaattgcaatgtgt   160300
ttatgacgtatttttatgatatttcagtacccgatatgttcattacccccatgtatgaagtcttatcttgt   160370
gatgatgagttgatcagacctattacattgagaatatttttaggtataaactttatatagtctctgatgg   160440
tgagtgtgtaggtaaattgctttgggctcacctgattgtattttcattgttgttgactttcattatttca   160510
```

FIGURE 8A-35

```
ctaatttgggagcaagggcttctttttatggtctatttctagatcatcttcccttagattacatcatgt      160580
aatgaactggcagaagatattaagtagatcttattcaaacaagaactttgaacctaaatggagatttatc      160650
aagctaaattagcctaattgtctgtaacaatgaccacagcatattaataaaacctgtgacccttacatat      160720
atacatgtgcatttaatgttcttccactatgaaaggcatttgtgatttaatctgcttgataacgatt        160790
aatatgatattcactaatttttactcatcttattcttaattcatctaatttatctaattcttagtaatct     160860
aaatgattcaagcctcttacagatttttatctctacccagttttcatccagctgtccgtgtggtcatct      160930
ctgccttggtgtgcttgagaattatttctgattctatgacaccaatgcactttgcagtctttgaacttga     161000
attggcagaatcaagctcctctagacaaatcactgaatctcttttctcacgttaaggtttgtaggaacc      161070
ctattctcaaagctgccaaaacactactgcttagtctatgcaaatcaacaactacaaatgcacgtcactc     161140
aatcaacattatgaaactccttttttggaatgattgatgatcacaaaatgtgatcttgtgacaatatgata    161210
tattcatttaagccacattgaggtttcaaattggcaccattgacaacgtacctctttcatgctaagtgta    161280
ataatttgttgcctctcatttcctatgctgcttcacttcattaaatctgaataattaaaaattttcgta      161350
gcatcgccaaagtcacttcccaggagctagggaatgtgtcgatctgtacactgatccagttcctgctgac    161420
gtttgcttggatgcagaggccatccatcgctttccattgattttgtcaattgatgcttttcttccttct      161490
ttcctggtgacttaggaaatgttctgaaactgtgcattcaagtcaacacatgttagattcataactagga     161560
ttcaccttcacagtggactggtcccaatttgctgtatttattcagcctgtcaactcacactatctgac       161630
taaaagacgctaatgcagtgttggccagtccctgtcatctcttctaattgtttggtctcaaagcaatg       161700
gtgcatgttacacatatccatttaactgtccaattaacgcatgtttctagacaattctgatagaaagggt    161770
ctcttttcttccttcagcccaaacaaagcaaaacaaaacaaaagggcacttacacgatgttgatctatgt    161840
tttatcttttttttttttgagatggaatctccctctatcaccctggctggagtgcagtggcgcgatccc     161910
cgctccctacaacctcgcctcccaggttcaaacagttctcctgcctcagccttccgagtagctgggact     161980
acaggcatgcaccaccacacccggctaagttttgtattttaatagagatgggggtttgccatgttggcc    162050
aggctggtctcaaactcctgacctcaagtgatccacacaccttggcctcccaaaatgctgggattacagg     162120
tgtgagccaccacccctggcctgtttttgttttatcttaaatctcttaggctgagactcatatggtccca    162190
cttacccatctttttacagcatgaaattgtccagttaaaattacagctctttattaatggccttaagact    162260
cttcattttgaatggataaaatagtaataggctgtgagcaccaacagtattaatgtatcattcatgcatg    162330
atatagtagttgacatctttctttttctgttttaaatgaagttcaggaaaccaatatgaaag            162400
gtaagaaattgccaacatcttggactatcaaatcatggcagacaatgaattaaagaattcaacaaatctt    162470
tggcagcatcagtttcaaaggtatttagatacaaccaccgtgtaattctacacaatttaattaaatcatt    162540
tatcaaatcctctacaacttgaataatttaactgatatcagaataatccatttttcagataattattttt    162610
atatttaatgtgttaaatataaaaatatgacacttctcttgcataatttgcagaatgttatttatttcat    162680
tatttttattattttttaaaatttcaacttttattttgatacatgtacagatttattaaatggaaatatt    162750
gcctgatgctgggggtttgcaggaaggatcctgtcacccaggtagtgagcataacatccaataggtagttt    162820
tgtaagccccccacaaccagcaccctatagtagttctcagtgtcttgctcttttgcccaggtgcaatca    162890
aagctcaccacagcctccaactcctggactcaagtgatcctcctgcctcagcttcctgagtaaataggac    162960
tacagatgccaccatggccaactaattttttaatttttactttgtagagatggagtattgctatgttgac    163030
taggatgatcatccactcctggcctcaaatgatcctcccggctaggcctccaatgtgccaggattagaa     163100
gtgtgagccacctcgcccagccccaatgcttgatcttcaagagcttcaggcagttgaagggttttgtctg    163170
cctgccacagccttccatctttttgagatgtgtttacctgagacagctaagtaggtgacaacctgaacta    163240
cggttgctggcaattggaaaacagaagattgctctgttgatccattgggagaagtacagtagtctgtaga    163310
ggaacagaatcccagggttttttcctggcatggaatcactctagagagccacattaaaaatttaattcct    163380
gctgagcacagtggcttacgcctgtaatcccagcacttgggaggcgaggcggcggatcatgaggtca      163450
ggagttcgagactagcctgaccaacatggtgaaacgctgtctctactaaaaatacaaaaattagctgggt    163520
gtggtggcgtgcacctgtaatcccagctactcgggaggctgaggcaggagaattgcttgaacccgggaga    163590
tggaggttgcagtgagccaagtttacaccattgcactccaccttgggcaaaacaagcaaaaaactccatc     163660
tcaaaaaaaaaattaattccccttgactgttgattttattttattattattttttagagacagggt       163730
cctgctctgtcttcagattggagtggtatgatcatagctcacctgcaacctgaaatcctgaggtcaagt     163800
gatcctccacctcagcttcccaagtagcttggttgacaggcatgcaccactacacctagctaattttc       163870
tattttatttttgtagaaacagggtctcgctctgctgcccagtctggtcttgaactcctggcctcatac      163940
gatcctccacctagttcttccgaagtgctgggtttataggtgtgatagtgccgagccatttggctgctg      164010
ttttacatttataccattatcttcatcctaaataggaattctgatagtattgttggcagaataggtca     164080
actggaacacacattttgttctctaggtaaagatgatgaaacttaaaatgtagctaatgttattcctgc    164150
aatgaatatgtcaatttctaatctggggacaaaaataaataaaaaaaagttgcacgtattaaacacctt     164220
cttgactaagtggcagctgtaatgatttcacttggggatagccattgcttcttaactcatgctaacagtg    164290
cattaaagctattgattttagtggctgctgtgctttcgtgattgtagatcatttctctcttgggaaact     164360
ctatttgatgacaaagctggctctgttgcagagtaatgataaaagaaaggacctaccagaatttcaagtg    164430
aaatgtataacatatgtgataatgcatggtgactgcaatgatttcccgatgttgctgtttaatagcc       164500
atgaaagcatcctactgaaatagagtatttctgctttgaatggcttagttagctcaaaaattttgaaagc    164570
tttctcagtaaagcatggtgccaggcactgaaagattcctttggaggagccagagtcaatttggatgat    164640
gtttataaaatgctgctggaaaatttgggtggtgtttttctaaatgatcttcctagtaatgatttatgctgt    164710
aaatcagaaaggttgccatctctctggatggaaatgcatagtcatatgcccgtaaatgcagggatttgac    164780
ctcctataaaaaagctctctctccccctccatttatgtgatgatttgtataccatctgagcgctgagaaac    164850
ccattggccatcttccacttgtgtgtggctggaggtgcttgctgcagctctgtgatgccctgagccagca    164920
tgctcgtggagttccagtctgctgcatgaacaagtggagaaacatgatcttcctaaactgctcacaagct    164990
gctaaatgagtgatttgtgttcccttt                                               165017
```

>HNL4 Exon3 (19479-19631)

```
cacctagttcccccaaaacggggtccattagctatttatgctagtgctctcccttccccccgcctccctga    70
cagaccctagtgtgtgttgtttccctccctgtgtccatgtgttccaattgttcagctcccacttatacgt    140
gagaacatgtggtgtttggttctctgttcctgcattagtttgctgaggataatggcttccacctccatcc     210
atgtctctgcaaaggacatgatcttgttctgttttatggctgcatagtattccatggtgtatatgtacca    280
```

FIGURE 8A-36

```
catttgctttatccagtcaatcattgatgggcatttgggttgattccatgtctttgcgattgtgaatagc      350
gctgcaatgaacatacacttgcatgtccacattgagaaaccatctcacgcaagtcagaatggcgattatt      420
agaaaactcatattctttaataacatctttgaaatgatgattcttcagtcttgaatcatcagtgcttcca      490
ggccataccttccccattcttaacttgaatcctgacttcattcttgagcttgttggagttgccctgagct      560
tgatttcttagagtgaattatcctgtgattttttactctatgcctaagttagatggactttcttagcatgc      630
taatctctaaaaatacctttttcaaaggagagattgggaaaggttttgtaccaaaacatggtagatcttgt      700
tccattatcaactgcgtctcgtgtcagagagttctaaggtgagtgaaattgtgcgtgtttgtagcgtggt      770
cataaagacatttcacagagtggatcgcaaacaaaccaacagagcacagagggcttgagagcaatggcag      840
ctggtggaagcacaggacagggcacagcgggaatttcatgggaccacgaaccaagaacagaacccatgac      910
caggctgtttttccttccaggggcccaggcttctcagctcagccttcacttgcatgctgctttgagcat      980
gtttggcttctttgagaaaatgagccacccaagaggcctacatccaagtcacctgcactcagatcccagc     1050
caggagtatggagggcccatgtgggtggagtggtgccacgtcctccaccacccttagacacagggaccacct    1120
acctcattttagatggagtgggcagataatctgcacacatacctccaaaggtgtcctctattgtagagac     1190
accttttgttttctccctcaatcctggacattttgtttgtttttctttatttcactaattttacaataa      1260
actgccaggatatgtctccatgtctagctcttttttgtgaattattctggaaataacagcctctgcaaggc    1330
tgctaaagtgacaaaggtatttttcaatcgcgtctgattcctttcagatatttccatcttcctactccat     1400
catccatctcttttttaaaaattttgttttgttttttgagacaaggccttgctctgtcacccagattggagt    1470
gcagtagcatgatcgtagctcgctgcagccttggtcccgggcttaggtgatcctcccacctcagcgcccc     1540
caagtagctgggactgcaggtgcacaccccacgaccagctaatttttgtgttgttagtagatactgggtt     1610
ttaccatgttgcccaggctggtctcgaactccgggctcaagtgatccgcctgcctcagccttcatgttt     1680
tctttaccagttggttccctctctttcccacacttgctaagaccactactggttcactgtcacgatgtca     1750
cttactttttttgactaccttcagtgatctttcttttctgatttatgtatatattttcctgagtaatgtcat    1820
tctttattaaaaatgtatatgtatatatgtgtacacaaagtatacatatatgtgtatatatcctaaatgt    1890
attctattatttattgaaataaataatgtatgtataattatatatttatatataatgtaagcattagtat     1960
ataatgtatattatgggatacattatatatacatttttatacacaattaggttctgtgtatactatatatgt    2030
atgtatacagacatgtgtatatatatatgtgtttataatatatacaaatgattgtaacagtgtgtgtata     2100
tatgtgtttatgtgtatatatagtatatatataacattaatgtgataaaagtgtatgtgcatatatgtgt     2170
atttgtgtttttgtacatactcatgaccacatttaaagaataccattgtaaaagctgaccatataatcgt     2240
ctatgcgcatatatatatgcagcaaaaatgccatcatcttcattaataaatgccttctttattaataaat     2310
atacattggttcacaatatcaacctcagcattatatacatttcaacaaacatgctcattgttttaagcat     2380
acattattaattcatatttattttgttttaagttgagattgttataactccctcttttttcaaattttta    2450
gctaatggtacttttaaaagaatgacttattgtattcaaattatcactagtgggataaataatgtaa      2520
tgatgggaaaaagcttcctttgttccagctataattatctgtagttgtttatttgttttattcaacttaa    2590
cattcatgttttattcaaatcatcaatatataatgatttgttctgttaccaaagatcttattgggaatt     2660
ctaaagtaataaattattttgaagaggtatcgatactattcactcttgatttatacctggatcaatgaa     2730
tgtttttaaatatgtaagcgttcttttatgtttcttgttattttatatattttatgtaacatgtgctgta    2800
cacttcttagagttattgctagaacatttatcatgaatgtgcaaagaattttttcaaatatatttatgtg    2870
catatatatgacaaatcattttgtgttaattttatacaattctaaataataagtgactcattctaaatta    2940
tttagctgattctctagattctctttctcttgttggatagtcatatgcaggagtgactttattttgtctc    3010
cttcttctgatattttcagttctcaatacttttaataaaaacatataggcttcgagtctgtagaagta     3080
tcttgaaatatgatggtgatgatgaacatcattgccctgtttatactttagtgaaaattcacttagtgc     3150
aacatttcttttcctatttgttgataagattaaaaaggatttcctgccaaataaatattccatgtactc     3220
tacttttttaaattaaatacattaatagtaccagatactatttgccatctttcaaatagcttttttctcct    3290
ttgatctttccctcagctatcacctgacttctttccttcaactgtgaatgagacaaagcaaaacaccta     3360
cttcttcccattgaaccatcttactgtatttgtagagtcaacctaattccttattaggtcactgcatagt     3430
ttttttttaatttaatattttacgctatttattataatgatcattggaggaataatcagaacgtgttaag     3500
attcttttacaagtaacttttacattttagtgttcttggcctttgaactgcgttttggatgaagaacttt     3570
aggattttctgtgcttgggggtgctaaaggtgtttacacctgagtgaatgcccagaatttgatcatatag    3640
atttttctattgacagtctcaccttcttatggttattctcttgtaaattatctttacctcaagaccaaga    3710
tttgcaaatatattgattttcagtagatgcagtgttcacatagtatctcctgaaacaatcacttttgca     3780
gtgtcttttgtatatcactggttgcgtcccttactcagatctaaggtacatctgtttctgtattttcc      3850
ttatgagtggtctggattttaattctttcaatacacttttatattttattggagtatgctttgccaacgca    3920
tccttttttatctcagactgttctctatgtctctgtaataaagaaactgcatcttattttactccatgaaaa    3990
atcacaaatgattcctaagtgttcctttagagtgttcctgagaggactgtggttgtctttttattctaca     4060
ttgtgtgtctttttttaagactttattagcgcagttttaggttcacaacaaaatagaggggaacgtacaga    4130
gagttctcatatatccctgcccccatacatggacggtcttccctattttccacatcacccaccagaggg      4200
gtgtgtttgttacaatccatgaacttacactgacatcttcatcccaaagtccgtcctttacagtaggc      4270
tacagtcttggtggtggtgtacattctgtgggttcagacaaatcgtaataacataactcaccattaca      4340
gtatcacacagtatagttctgcaaccctaaaaatcttccataaaaaaacctccacaattttagcagtttg     4410
taacaacaaaggcttatttccttttttctgaagttcatgtcggttgtgggtggacttgcttgttacttagg    4480
tagactgatattagaaggtgggaaaagaataatacctctccaggaaaggataggaactatttgaaccaa     4550
taatacagctcactacacaaaatgagtgaacacagtcacactgaaagagagatgagtgacatatgcttaa     4620
gttatgttatgttgacaaggtctcactcacctaaactgagtgcagtgccacaattatagctcactgca      4690
gcctgcaatccctggactcaagcagtcctcccacctcagcctcctgagcagctgggactacaggcacaca     4760
cctgtgtgattttgttatttatttatttatttatttttaatagaaacaggttctcattatgt      4830
tcctagactggtctcaaacttcagcgttcaagcagtcctcttgccttggcctctcagagtgctggaatta    4900
caggcatgagccactgcgcccagcctcctttagtgtttaactgaacagaataaagaacctcttcattatg     4970
gtgaattggctaagttcaaaaggtagcaaaagcctcgtgggcagtaataattactctatcttccaaat      5040
acttgagtgaccttatgcttcttaaaatatatatttttagggctcttaattgaaatcaattgccttatag     5110
cctctattacagcatactcagaaattgaagagcgggatgattttgtataaatctagactaattttgttttt    5180
tctggaatgactagaaccattaccatgtcaggtacacacacaagaaacgctaagggcgagttgtgaatg     5250
atttgactaggaacaatagttgggctgcttttagatgtctcctttttgctacatagacagcaaaaggagaa    5320
ttcaccaaaggtgccagcccttcagaatccttgtcccacaccaccaaaaagtcctgtgacagaaattcca    5390
```

FIGURE 8A-37

```
cctattaatcagctgctgtgtcctgactacggagaaaagtatgatgcaacagaacgcaaacttttccaca      5460
atctcataacaaggaaaaaatatatgtatgtataatatgtgtacatatataagaaaatgtatattacata      5530
tatagtaaatacatacaaatacacgtatgtgtgtatgtatatatatacacacatattttgttttgttaggta    5600
ttttttatgactatttatttaaaaaagtcacattgaaaataaaattgactttctatttgccctaagttacc     5670
tcttgaaatattgtgttaaaaacctaataacttctgacaggtatatatataccctgtagaggttaatatat     5740
atacgtgtgtttgtgtgtgtgtgtgtgtgtgtgtatgcgcgtgcatagaagttattaggttttgttg         5810
tttgatggttttgttgttgtttttgagatggaatctcactctgtcgtgcaggctagagtgcagtggcgt       5880
gatctggctcactgcagcctccgcctcctggattctagtgattcttgtgcattctcccaagtagct          5950
gtgattacaggcatgtgacaccatgtctggctatttttgtattttagtaaagatgggatttcaccatg        6020
ttggccagacttgtcttgaactcctggcctcaggtgatctgcctgccctggcctcccaaagtgccaggat      6090
tacaggcgtgagccactgcgccaggcattattaggtttctagtacaacatttcaagagtatatgtatag       6160
atatgtgtacgtgtgtgtgtataatatatatatatatatatatatatatatatatatataaaacc           6230
tctatgggtatgttaggttttttaatacaacatttcaacaagcatcttaggacaaatgaaagtcaattatg     6300
ttctcaacatgacttttcttaataaacatacatttaaaaatacctagcaaatacattatttagtaccta       6370
ttttaaacacactgtggtttaatctcaagctcatagattcttcgagataatattgtctatcagctgaaa       6440
attctaaaaaaaaatgggaaaggctcatgtaaatataataggatttgtatttcatttctgaggacagaa       6510
acatttcaatagtaaaatttgcaacaaaaagtgcttatggaaagttagacaatgctctaggactctaata      6580
gtaagcacaggaaatatgtcagagacccataaaatctttagatttattttgattcctacctgtaaaagtgt    6650
gaaatcaattattgctaaatccagcaaaacagcaaaggaaaattactattcacctttttctctcagtctg      6720
tcttccaaagctactaagagaaaaacaagaaaaatacagaaaatcctacttccattattacaatgaagca     6790
tttttgagctagtagaaaattagaattagaccttgcttttactggcatcacaaaagcatttcatcctgtt     6860
ttttgaaatgacaaatggcagaattcttatatacaatatgctaaccaaaatcatgttattgccacgtcat     6930
gaattataatttaatttctactctcaaagttaaataagaagatacaatattgcattccctgcttgaaga      7000
ggagaattagttacacttgttacgtaaaggctgtattcatcactggttgtcatagctgttatgactgtga     7070
ctcttataatagaggtgggcttgcagccaaaatatatgattcatccaaaagatatttaccatgtaactt      7140
atattatatgtgctgaatattttggtagtcattgcaaattaaggaatatggtgttgaaaaatcacaggta     7210
acacctttttcttgttgctaacaatctaacagggagacctttattaacaagatatcatattacacattac    7280
aattcatcttgtgaagaaaaatgccaactacagtcgaataattgaggaacccaagttcatttacgaatgga    7350
aggttgggatgaacagggaatgcccttctgaggaaatgaaatttaagctgatcagtaaaaatgaatcttc     7420
caggagcatatgggctttgcagatgggagaaacagcagagaatgcccaaaagttctaaaggaaacctgat    7490
gatgaaatgagttaagccatgttcctggtagtgtatcagttagcttttgctacataaggaaccatctcaa     7560
agccgagcatctcaaaccacctttatttagctaagcatctcaaacaacctctatttaggttatgattctt    7630
ggctggacatctgggctgtgctcagctgggaggctcttcagtctagagtcagctcagttccaggtctgttgggt 7700
gctcattggccaagcactatcttaacaggtgcttgacagtgctccatgtggaatatcatcctctaacag      7770
gctagtatagactcttcatggaagcttgtcagggttgcatgtaggtgtgttcaagtcctcttataatgaa     7840
agctaagaataaggacagtgtgtcacccccacatccggaatgtccaaataagcaaatccagaaagacac     7910
agatgaatgggtagtttccaggggctgagagtgaccactaaatggtaccatatttttttgggggggatca     7980
tgaaaatgttctgccattagatattgtcaattattgcacagatccatgaatatattaaaaaccattggat    8050
tgcatactttgacacggtgatgtgtatggtatattaattatatctcaattaagcaattatatctgtctat    8120
catttatctgtaaaccagataaaataagacaggctaggtatatacaaaaatagaacagaacaaggtaggc    8190
agaaacagaatctagcagatataaaacttggcatgtaagtaaagagctgtaataccctatgtagctgaaaa   8260
tggaactgttctctaaggaaataattaaaataatctctatgctctagcatccagataaatataattccagg    8330
tgagttatgacccagatgtgaaataaaaccttaaaactgttaggagaatatgtaagcaaataaaatgtct     8400
ttatgtttctggattaagtaatcctttttttttaaaaaagcagaaattatagagaaaatagtgataaat     8470
tataatacttatgcattttaaagcattagtttagataattaaaaatcaataaaatggttaaagacaacag     8540
actagatatcaccaatgctcaactgtgtaaacttgggcaaattatttaatatctgtatacctaattttcc     8610
tcagctataaaatgatattagttacacatctcataaggtatttatgaagattgcatattcggagctggac    8680
acagtggctcacacctgtaatacagcacctttgggaggcgaggtggggaggactttgaagtcccaagagtt   8750
caagactagcctgcacaacatagtgagactttatctctacaagaaatagaacaaaattaaccaggtgtgg    8820
tggtgcacacctgtagtcccagctactcgggaggctgaggtcgaagaatcactggagcccttgagttgga    8890
ggctgcggtaagctacagttgtgtgactgcactccagcctgtgtgacagagcaagactttgtctctaaaa    8960
aacaaacaaacaaaatgcatattcaacatgcataaagcccttagaaccatacgcagcactgctatgcact    9030
gttaaatgtttgcttttacatgctcaaaaagaggccagcatccatgatataaagattttcctacaaatca    9100
ataacagacattcagccagtcaaaaattggattgctattcaagatgggaattttagaatgggaatatagaa   9170
atgcatctgtactagtttttaaggaacatccaattgaaatataaactgttaatattttatactcatcaaa    9240
gtggcaaatgtattgtctgataatgtcaagtgttggcaacagggtaagggccaggaaattttcttacctg    9310
ctagtgggtgtatagcataatacaacttgtttggaaagaaatatgccagtatctactgaagataaaatta    9380
gtattaccctatgtatcagttagctgctgcataacaaaggactctaaaagtcaatgccttaagacaa       9450
taagcgcctattactgcttatgagcctctgcatcttgttagctggaaatttattttggtcttggctgggc    9520
tcattcatgtgtatgcattgttgatttggagtgagttctcttaggtaattgggggttgctggagtaatt    9590
ttgcctaggttagggccaatgggttcttctctatgagatcttttgttgtgcaacctgctagtctgatttt   9660
tcacaggacagtggcagaatttcaagagagtaagaataggtacaggggatttgagtcccagtcttggaaa    9730
cagcacatcattatattttttctttgaaaaaatgcaatcttaaagactcaagattcaaggggtgaaa       9800
gtacagactctctatgtatgaggaatagtaaattcatgggaggattgtagaactgggaacccttttgcct    9870
gtcagtgcactacaccctgtaattcaacaattgtctatctagtagttatgtgcctggaactgggtctt      9940
caaactggcagatgtcttttcaaaatttttcaaagtatgactctgctgatgatttaaagaaactaattt    10010
tcaggtactcagcccccagatgttctccttttctaagccttcctggtcaccaaaagcttcttcccacatca   10080
caaaaggatgaccttcagtaggcatgacacttgttaccaaccttttctgccagggttttataatacaaga   10150
aatatcttttgaatgctgcttctggaaagccccctttgctgaaggctccataaaataagcctcctatct    10220
tatacatatttccattaagagtgaagtttggtcctgttcaggtgttctgatttcagaaaaagaaaaaaga    10290
agccataggtcagctatggcagttctttcaaatgcagaaactgaacttttctgttgctaaccaatttttc   10360
aaggtgcatatacattgggtgaagcccatcggtaaatgatccaatccgaaaatcatctgaaggtcatctt    10430
tcaaattcattgtggtagtgttattcaagtggaggctcaaatatatttcaagtgtatgcatggaatattt    10500
```

FIGURE 8A-38

```
tccccagctagagtctgttctccaggtgtatggaggaaagaggagttgtccaggttgtgtacctgttctt      10570
ctcatctttctggggctattcatgtccttctgtgccctcagcctccaacccatgcttctgctcagagca      10640
gcctgtttttctttgctcccataaatgtattcctggcccagatcttctgtgcatatttagaagccctaac      10710
ccacttcctcaccagccaccctctatcccagactctcctaccaggaacagcagaggatcctaaattca      10780
tgcatgcattttcctgcccgttggaatgatctgtgtgcatgtctgtctctgatgttcatctccttcttc      10850
agtgtgggtgtgtcattacctcttttagccaggactgcatggcattacctgtcttagtcgggactgcatg      10920
ttaaaagggtcaacacatatttgtagaagaattggcttctgagtgaatgaacccatgtgtcatggcag      10990
tctgtgaggacataccagtcacttccttgctgccgagagctgggattgcattggattagaagattaa      11060
gcccatattactctatggccaagtgacaaaataatcaatcacatccacatctgtgatagccaggaaaaca      11130
tttctttccgtgccctcccccacccccgccgtatgcaacttcctgtgtggaataatgtacttagc      11200
ttaaaaagtctcttctctacttaacaagactaagttgaaaattaaccttgcccacttaaaagaaaacga      11270
atatgcagtaaactatgaactactaatacagttcaatatgatatctcatgcagaacaataatgctgaagg      11340
ttcttttggttctattatttccttatattcttgcttagataagatcacatttgtatctattgactttct      11410
atgatgatttagatacataagtggcaataattaatatattaaaaatacagatttaaattgtttttctg      11480
acttgtaatgttaacagcagtatatgtgactgtgaggttttcctttgatgttaattttcactttgacaat      11550
agtcttcgttttccaatttttttaattttttatttttattttttttgtgataaggtctggc      11620
tgtttcacccaggctggagtgcagcagggcgatctcagctcactgcaacctccacctcccaggctcaagt      11690
gatcctgccacctcagtctcccgaatagctgggactacaggcatgcaccaccatgtctggctaattttt      11760
gtaattttcatacagaagaggtttcaccatgttggtcagtctgttccagaactcctgacctccgcccacc      11830
tcgacgtcccaaagtgttgggattacaggcatgagccaccgcgcccatatcatttccaaattctttaca      11900
aagtttttctcttacattcataacataaagtgctatttaaatagactaacttttgaaaataacatagat      11970
aaagcactaaatggggacatcagaggaacaggctaaaaaaagctggaatattcttcaggattagggaca      12040
ttgagattttatttataaaatgatatttaaatttaatatgaattgttgtacttttgcttggagtatt      12110
taaatcttctctcttaatatttaaagccagttctgtcacagaggtttttacggacgatgctaattgttgtatga      12180
aaaggaatattattctggaattttgaggaagggtagacatagagaagataaaggaaactcacagcctacc      12250
taggttttatttgggctgtgtgtgtgtgtgtgtgtgtgtgtgtgtgtgtgcgccagccacaagctgggtt      12320
tattcttgaataaactgtagacaaattgttttcctgaatcttctaaaacctgcatttacatagtccatg      12390
gttgtgtctaaactagatactcaagagaacttggtttgttttaaagcatttaattagttatatttacat      12460
ggacaaatagagcagcagttttattaaaaaagatgaaaggataaacaaattaaatatacgtagaacagga      12530
aagacagcatctaattatgtttctgggtcaggctctgatatacaagattaatttaaaattgggatttggc      12600
aagtaatttctatcgaaatctcagcaggagttttttattgcaactaacaagctgatttggaaagtttcatg      12670
gaaaggcaaaggatctagagcaatcaaaaagaccttggaaaaggggaagaaagttggagggcttccattt      12740
ctctattttaaaaggtactataaagatatagtcaagatagcaggcaactcacatgggtataaattta      12810
gaccaatgaaatataattaattacagttggcccttgaacaacgtgaaggttagaaccccctgcacagtcga      12880
aaattcacttaaaacttttttacccccccaacacttaacaaccaatagtctactgttgactggaagcctta      12950
ccaataacataaacagctaattatcacatctttttgtatgttatatatacaatgcactgtattctcacaat      13020
aaactaagttagagaaaagaaaataccattaagaaaatcataaggaagagaacatatatttaccactcat      13090
taaatagaagtggatcttcttaaagatcttcatcctcatcttcaggttgataggctgaggaggacgagg      13160
gagagagaggttggtcttgcagtctcagggggtggcagaggcagagaaaatccacatataagtggatct      13230
gcacagttcagaactgtgttgttcaagcgtcaattataagggttagaaataaatccttcaatttgtagt      13300
caatagattttttaacaatggtgccaaaacaattaaaggaggcaaggatagtcttttcaataaatggtgct      13370
gagacaattggatattcatatgtaaaagatcaatttcaactcttacctcttattgtacccaaaaattaa      13440
ctcgaacgacaggtggcaatataagaattaaagctcttaaactttaaggaaacttcagcaacacaggaga      13510
aggtcttcagggccatggattgggaaagatttcataaatatgacctcaaaagtacaatcctaaaagaat      13580
tgatcaagtgaaactcatcaaaattaaaaactttacacttcaaaaggcactattgagaacataaagtgc      13650
tatttgttgagaaaccaaaagacaagccataaactgggagaggagatttgccaaccatattcccaataa      13720
aagactttatttagaaaatatgtaaacaaaccacttactattcaataataagaaggaaagaaattattt      13790
tttaatgggcaaaataaattaatagacatttctgcaaagacagtgtacatgagaagatatttaatatca      13860
ttagttactaaacattagctaaatgcaaatgaaaactacaatgaggccaggtgcagtggctcatgcttgt      13930
aatcccagcactttaggaggccaagatgagtggatcgcttgaggcaggagttcaagaccaacctggccaa      14000
cagggcaagacccatgtctactaaaaatacaaaaattaaacaggaatagtggtgcatgcctgtagtccca      14070
gccacttgagaggctgaggcacgagaattgcttaaacccaggaggtggaggttgtcgtgagccgagatcg      14140
taccactgcactctagcctgggcaacagagcaagactttgaaaaaaaaaaaaaaaaaaacctatgatgaga      14210
caccatttcacatccattagtatggttataacaaaaaaggatattagcaagtgttggctaggtattagag      14280
aaatagagacccttataccaccgttggtgagaatgccaggtattgcagctgatttggaaaatagtctgt      14350
cagtttattaaaacattaagcataaatttgccttatgaaacagcaatttccaccccctaggtatctatgcaa      14420
tagagatgaaaacatatatccatgcaaaaaatagtacacaaatgttcatagcagctttattaataataat      14490
caacaagtagaaataaaccaaatgtcactcaaaaataaattggattttaaaagatgtggtataccctacca      14560
atggaaaataatttagccataaaaaggaatgaagtattgatgcatgctacagtatgaaaggacattgaaa      14630
acatatgctaagtaaaagaaaccagacacaaaataccgcatattatatgagttcatttatatgaaatgcc      14700
tagagaaggcaaatcttataaagacagaaagtggatcagcaaggctatcacacccacgcaccacccaggt      14770
ctggttttaaaaggtattaagccccatgaaatggacattacttgacttttgtttgatatatggaaacag      14840
cattatcaagtcttggtttcaaaatatgtttaagctcttctgagttatgtagaacagaggagtgttttcc      14910
attcacaagtgttggagatgacagtatttcctttgcctaatccgcttatcctagaaccctataggaa      14980
ggcaaagactgtcttgattgattgacgcagttaaagttattgatagtgggatatgcacatatgggctgca      15050
tctgtctatgagaaggaagcaatggagccaattaattaattcaagcaaaattaaatgttcacacctttta      15120
aatgtggaaactataaaaaccaaaatggtgctctgtgcactaagagcataagctagttttttgctatcct      15190
taagggcctcttcctgcattttgcctatattaaaattcctatgcagatcttattgaggtgatcaaggtag      15260
atgacttcgattttattttcttcaacaaattcacgtaccaataactttcaaatgatatttagtaactat      15330
tttaaacacagaggacatgatcttcaaacgatatttaatagctattttacacacagagggcataactttc      15400
aaatgatatttaataactattttaaacacataggacatggtctataatgttttgtcctgacttaaatatt      15470
tattgcatgtagtagattttaatagaagaaaacaagagtgaatagtgggtagtgcttctcaaacacaga      15540
gtagaggtaaatcttagtgatttaaattagtcacaattctgacttttttgagattgcatgtttataagttt      15610
```

```
ttaatgcatgaaattaatgtcaattatataatattttgaataaagtccttccatgtttactgtgttttg    15680
cttgccttatgaaaatttctaaccataatgtgtcagtaacatttcaaaaatttatttaaattacaacatg    15750
ttaacatcagaggaccattgaatacgccataagcatttctttaaagaatgtgggaaatgtcttttctaat    15820
aatttaattttttctttttttaaaacaactcacgttagcattttttttttgcagtagcatcattttaac    15890
ccccaactgcatattcacaggatatctaatattttttgcaagtaacattttgaatttgttcttcttgaca    15960
tctttatgtgtttatatgcattttgcatttccctatctcattttttttgaaatccaaatgtaacaaatttcaa    16030
cttttttgtgttacattcttttctttttttctttttctgggtagcatctctctcttttctgaattttttga    16100
aaacctgttgttttgaattctcttttttcccttatttttccttctcaatatgaccccaggagccaacac    16170
aaagaaaaacgcagatgatataacgagtaatgaccgtggtgaagacgaaggtattttttgttttttcaaa    16240
gctcaacccagtgcatgatttttatatctatctatctctctttttttttttcatttcaatctgttttttc    16310
tccccttatttaaaactagtacactttggtgtgcttccttaattattttcttcttgtatagaaaccactg    16380
tcattttttaatcccagttaccatgtacaggaaacaaatcactgtgagaagtataaacattgtttctaaa    16450
catgaaaagagtaatgaactactgttacagagaagccctttttttttttttttggcttggtcgcaaga    16520
agagaaaatggaattttaaaacatgcatgtatagtctattttctcccttccaaatgttatttttgtaagtt    16590
aatatactactttggagctttggtcttcttaattattttttatgaactacaaaactgtacagcaccttaga    16660
agaatttttttggggggggggggctgaaatatcagttttttttttctcacaaacatattgattccaa     16730
catagatttctgataatctgctcacagtgaagtacaccaaaaagtgtttttaatgagatgctgttgttaac    16800
gagccctgatgcattcaggactgcctttacagcatttaagggggggtggggaagataagagtatctcag    16870
aactgaaaaggacaaaaagctagctatgttcatctttcttttcacaccacggctttttgaaaacgttt      16940
ttctccttaaaatgttttgttgctgtgaagtttcttcttaaggctaccaaattgctcaacacattgtcta    17010
ccagaagtgaaaggattttttttttaaaagatggtaggtctgaggtactcatgcagacaactcgcatgctg    17080
tttttctgccctttctgcacaagaaatgattttttttttttttaaagaggagaagcaacaaaaaagtac    17150
tcaagcaagcccttcttcattggtaaggctctataggattagctaaaagcacattttttcccatctgggta    17220
gcaaaatgcatggaactccattaaggtcctggctggacctttgggtctctgtctgaaaggcaatttaaag    17290
cccaaaagtgagtcctgaattatccttgctggtcaagcccatgacagggtcttttgaccaatt         17360
cttgtagttgctccctccttgcttatcttcataaatcaactgttctccaagaaaagaaatcttgccaac    17430
acccttgctgtgcccagtcttcccttaacattttgagtattgttacttttactgagctcatagagctgtc    17500
actgtctcaagtagctctctgagagatctccattctgatggccataggagatcaaaatctacacctgctt    17570
caggtagcccctctttgataagggcttctgaatgcctgacatttatcagtattgagcaaatacataaa    17640
aatgaaataaactttttgtctcatatcttatactgcctcttaattgtatcctgtttggccttctcttttaa    17710
tacatttcctctcgataattagaatctgttttcacagtgttcccagtgaatctttattaccattaaaatg    17780
ccatctaattttcatttcatattgttaagttatgatttttttgactttgcattaatataacagctggttat    17850
tacttccacaagttcaagagagtcttgttctatattttatgaaaggtaagagatgttaatctcacatatt    17920
ttccaagggagcactttaaagcagcccttcaaaatctctacttactcttttttccacaatttactaggca    17990
accgctggtaatggtaaaagaaatgaggccaaaaacagcaaattaggaaccagaaagaagcagtggatca    18060
tgagaaaagccatttcttattcatatagcagaagacatttcccgtagtgtatgatgaataaatgattaat    18130
agaagattttttacttcatatttgaattttatatgagaaaacaaaagacacttttctgccgtggattaaat    18200
atctgcaaataaatacttgggtaacttgacactcttttgtgtgctttactgtgaccaatgggtatgtcgt    18270
gtcttctgtatgcacccagtaaaattgtgatcataattcattcaaattggagccaccatccaaacgatgg    18340
taattcatatcctcagaattcctttgtggtatttcaaaagtgtccctgtggattatgaggaaaaaaaac    18410
tttattgatgaagaaattgaaaataaatatgcataaatacttgagtttttcttttagttacaaagatattt    18480
aaattgtacacacacacacacacacacacacacatatctgtatccagaaatatttatacgtgaggtca    18550
gtcttccaaagattaaatgcagccctaatggctgattaatgttataaaacaggtcttttcacaaagcag    18620
gccctacagatggtctccaactttctatcatcacagatcattgttttacatcattgttaatttaaataa    18690
taaagtaaattaccaagaggaatcattggttgcaagtcaatgggagtttatattccctgtgaaaatat    18760
aaagcatttaaatagtttggattcttttgccattttttattacatctcttttattttttgtcacctaagta    18830
tgttagtatgttactgtaatcactggaacaaagacatttgcttggacatcttttcttttttttcccatt    18900
tctgttcagttaataattttttaactgttgattttgcttttcttgtcattatctgtcccttattgatagttt    18970
atagcttcactactactttttatgtttttattgttaaattgaagatgaatctgtacactcacctgcgaatt    19040
aagatgcaactatattaaaattaatatttgaagttgatttttatacttaattagaagataaaatat     19110
atttcatcaagggtcccatgtgtttattcaatttaaatcacatttaggggtttgagcaaaatttaggaaa    19180
tgtgtactttacctaaaaccatttcttttagtgctttagatatatatagaagcttagatgagcagagtac    19250
gctaaatgtctgtatgcttcttaaaataccatttccataaaatagaaaacgtaatagcattgatcatttc    19320
cttagacactcttatcaaggtcatatcatccataaaaataaatgtgcttaattcaagtcaaaataggga    19390
aatcagtgaatctcctttttttcttaatttagcattggtgagtcagtgttattccttttattgtgttccttta    19460
cttggcttttttttccagATATTCATGATCAGAACAGTAAGAAGCCCGTCATGGTCTATATCCATGGGGG    19530
ATCTTACATGGAGGGCACCGGCAACATGATTGACGGCAGCATTTTGGCAAGCTACGGAAACGTCATCGTG    19600
ATCACCATTAACTACCGTCTGGGAATACTAGtaagtgatttcatcatgtgaatgactgagcaagaggaa    19670
acatgaaaagtccacttctcgttttgacggggctcgtggatttgaatcctgttattccagttcctggtta    19740
attccacttcacggtatttacttttatgtgattggatatgttttattccttttactcctttgtgcaacatg    19810
gtcatgaatccccttctcaaaccaatgcagactttaagatcttaaagatgaaatgaaattttatttatagc    19880
atgtttctcccttggagttcaatgaatgtatgtttgtctacatagacctgtacaatgaacacatatttgg    19950
tgatattatagttgggaatggccatagatcttagctttcttttctgattgtgtcattgtatgaatcagta    20020
tattgtgtggaggaaaagattttatccaattctctaactgattatgttgagccttggaagatctgttgt    20090
tttggttccattgcatttgcatgcagggaaacttagctgttagttgactttgtccattgatgatctacg    20160
attaaaggctaaatacatggaaattcaagtttagttcctccttgttttgatgtttcatttctttctttc    20230
tttctttttttttttttctttgagatggaatctcactctgtcgcccaggctggagtgcagtggtgcgat    20300
cttggctcactacaacctctgcctcccgggttcaagtgattcttctgcctcagcctcccaagtagctggg    20370
actacaggcgcatgccaccacactcagctaatttttgtgttttaatagagacagggtttcaccatattg    20440
accaggctggtctcgaactcctgacctcgtgatccgcctgcctcggccttccaaagtgctgggattacag    20510
gtgtgagccactacgcccggccatcattcatcttctctaatttgtaggttggaaaattatacatcttcag    20580
agtcagatttcagtaccttctgagatggccttctctggtgttggttagttttgtgaataatattcctaaga    20650
cctatgtaaaaacatttgttttccaggcaaaaatgcattaaaatggtatagaagataaagttttttaacaa    20720
```

```
gttagccatgagagagatgtgtatattggttccagtgtgattatgatacaatatgaaatacaaaacaaaa        20790
tgaaggccaggtgtggtggctctcgcctataatcccagcactttgggaggcccaggcaggcagatcactt        20860
gaggtcaggaattagaaaacagcctgaccaaagtggtgaaaccctgtctctactaaaaatacaaaaatta        20930
actgggcctgatggcaggcgcctgtaatcccagctactcaggaggctgaggcgggagaatctctggaacc        21000
cagtaggtcgaggttgcaatgagcagagatagcgccattgcactccagcctgggtgaccgagtgagactt        21070
ttctcaaaaaaaaaaaaataataataatactagtaataaattaattaaaataaaaagcaaaataagatgg        21140
actaaaggaggtctgtcaaacaagaaatatgactgaaatgttttcttcaaatatggccaagaatatttt        21210
cttttcaatcagatgacttcatttcattttgagtgggttttttttttcctatgtgaaaacattaacctg        21280
taagaagccctaaaaggtggtgaattgctgagaaaccctaagaggtgttgtaagaaaccctaagagaaat        21350
gcatttcttactttgaaatgcaaatcagtcacaggtgttgctaaagttgtatcttttgaaacattgataa        21420
agaactcaaaattccaggttggtttctgcattaaagaaaataaacaccaccaaaaaaccttttagtgtca        21490
aaaaacttattatgtcgttggctttatttcctatattttttgtagttttctgtgagccacatcttggcgg        21560
aataatgtctctgaacttttgcatagcagtaattgcacgcttcactgaatagttttcagaggcgctggat        21630
agttgctttggctactagtgttggaaacaggaaattgtgcttcttgatgttttacaaaaggttcattctg        21700
acaaagaggtggaaggcaggaaagtatgtgtgaaggcattgcacaggccctcttcaaagggagcagtgtgt        21770
gcactgcctgtagcacggccacacggaagaaagcttgggcatgcttttctgagggaagcagtgggcatca        21840
agaaaattcttgctttgctggaaccacacaatattctgttgcatgcgtgatgaattcatgtgtctgataa        21910
gatagagtttcaaaataaattgatctccttttcccctaaagctcagttgtatcaagcaactctacacta        21980
tgattttttttatcagttttgtcccttcgtgaatcaattgcacatcttgcaaattagcctggaaagta        22050
tacacactttttttagaggaaaaaaaaaactaattgaaaaattgttaagtctactcttttgttatggagagt        22120
ttttaaaagtcataagataacagagagctgtaaaattggtggggaagaaataaaagaagcgatttagcat        22190
ctctatgccggtctatttacattcctccaatgagctagtgtggaacagccaagcacactacagacccct        22260
ttcatttgatggaatgaaatgtgccaagtttgccgatttacaggacgatagagactttaaaatgtgact        22330
gcgttggttttatcatggatcttgcatttactattgtcctcttgaaaacagctaggcggcatttactt        22400
ttgcttgcaggaaactcctattatcggtcttgaaaaaatgtttttaaacctttggcatccagatatttaa        22470
aaagatgatcaaataaaatacacagcaggcactgcaatgatcatttcagtgagtgcatttcatacaagta        22540
gatacaattttaggcaaaaagttgaaatattctttgagttcttttttcttccagtaaaagtcataaatgca        22610
taaatgttatcttcctacctgaggaatggaaaaatattgtttttaagatttttttttttttaatggagtaac        22680
aaatgctattctctgttacccaaaagagaggattaaaaagatgaaacatgcccataatggaagcggaatg        22750
ctggcattggaaagaatgtagatcgcagccagagacagacaggagctaacaacttcctctacctctgcc        22820
ttgagaaagtcagctagcgtttcctcagactctttccttagatgtagaaggcagtggtctctcccttgca        22890
aggttgttgtacagtataaaagttccatggttcaaaataccacactttacctcattaatatataatctgc        22960
ttgtcaataaaaaaataactttttttctttcttttttttttttttgagatggagtctcgcttttattgc        23030
ccaggctggagggcagtggcatgatctcggctcactgcaactctgcctcccgggttccaagcgcttctcc        23100
tgcctcagcctccgcagtagctgggattacaggcgcctgccaccacgcccgctaatttttgtattttta        23170
gtagagacgggggttttgccatttttggccaggctggtctcaaactcctgacctcaggagatccacctgcct        23240
tggcctcccaaagtgctgggattatcagcatgagctactgtgcctggccaaaaaataaccttttaaaaaa        23310
gatttaatggactcatgtagatgaagtttcataggctctcagcaggcaaccattacccagtcacactac        23380
aatttctagtgttattaataccattatgcattgtattaatactactgtttatccacagtaagaattgtag        23450
ctgacccaacctgtaatggctaactaatatctatcaaatattggcatccagactgaaccatgttaattta        23520
aaataacattacaagacacttgtagacattaaataaatcagaagatcatcatgtttgctattttttaaaa        23590
aataatcagaactgtgctacacaatcttgctagccattggccatataatttatgatccaatccaggacat        23660
gtttgagagttgctcatgtgctatgaataaactggattgtccaggcaaattgagatgtatcattatag        23730
ctataaagtaattatttatatctcacatgaagtgtcttctgattgaattggtcttcagtttgtttttaaag        23800
aagctgcacttctataaacagatttcctatgtgttctgctatacacccttgtcactaggaaggtgtatat        23870
gttaccagaaaggggatcctaatccagaccctaagagagggttcttgattctcgtgcaagaaggaattgga        23940
ggcaaatccgtaaagtgaaagtaagtttattaggaaagtaaaggaataaagaatgactgctccataagca        24010
gagcagcccgagggctgctagttggctattttatgattatttcttgattatatgctaagcaaggggttg        24080
gttattcatgagatttccgggaaaggggtggcaattattggaactaaggggttcctcccctttttagacca        24150
tatagggtaacttcctgacattgtcatggcatttgtaagctgtcatggtgcttgtggaagggtcttttag        24220
catgctaatgcattgtaattagtgtataattagcgtataatgagtagtgaggatgaccagacatcactct        24290
agttgccatcttggttttggtgggtttcggctgttttttttttactgcatccttttatcagcaaggtctttt        24360
gtgggcctgtatcttgtgctgacctcctgtctcatcctgctgtgctaagaatgcctaacttcttgggaatgca        24430
gcccagtaggtcccagccttacgttacccagcccttattcaagatggaggtgctctggttcaaacgtctc        24500
tgacatatatattcaagaatttggaaaacctcaagttcaccaatgcctctcagattagtcattgccaggg        24570
tgtgtggtgttcctatctgctcagaagccagaagccagcaaaatccttgctgagctgtacgtgccaggcc        24640
atttgcctggtctcacctacccacttgagtacctatgccctatcacccattcacctcacaacatccatac        24710
gtatcatttcaccctaagaagattagacattaatccaggtaataaactttcagaacaatcacctccagac        24780
agaaactgcagaggataatctgataaatctgaatccctgtaaggccattactgaatcaataaatactctt        24850
ttctccatcttagttccttactttagtataacttgagttctcccaatctgttttttttttgttgttgtt        24920
gttcatgatagtccaaagaccttcgatgtaaagagaatgcatcttgctcatgcttttttgatggaaatac        24990
ctggaacttattattccttcccctttccagttgtctccaagtgcaagtctgtcacctaccctgcagtggat        25060
ttcatctacctccatttaaatatgtatttccgtttagctcacatggtactatcaccttttggtgatcct        25130
atgacttcatgcttcatgtatgctgaaattaattgttgcttcaaaagagtcccaactatgtaacatcaac        25200
tcattgtgtgcctctatgtggctggcagatattacttcatttaatcttcgtaaactcccttggaagagtt        25270
aaccttatgtcctacctatgaggagatgaatgctttgaggtaatgggatttactcatggcatcacacctt        25340
ctagcagtcagagcagggactgaaacccgggtgtaactgaagccagagctgacttaccactcagaact        25410
catccacagccttcttaattaatgtcaagtatgaattagtaaaccatggaatgagtgaagaaattgagta        25480
tcactttagcatcagatgtagctttttatcattatgcaaaaaagttcttactgctgatcaagatacacaat        25550
tgtgataagatgcttacagtgtatttttaagttcctcaaagtgggtccttgaaggctgattcatttccat        25620
tcaatcgatactggtttgctttggttcacggtgatggtggcattaaccacaacaatggcatttgtcacat        25690
caaagctcttcggtgcagtagaactagtgtttcatcaggaaatttggtgtcctaccccagttcccatgt        25760
cattgctggcttgctgtgtcgtgtgcataaattgagtcaaatgatcatttcggtgcatttcttacaatct        25830
```

FIGURE 8A-41

| | |
|---|---|
| ttcacatattatagctatcctgaaaattttcatctgagggtagattgcgtcatggtcttctgaagttgtc | 25900 |
| tttctctttaagaccattcattgaataaacctattagacgcttggagtcataattgaatataagacaga | 25970 |
| aatggtttgatataaaagcaaccaacatgcatagcagaaacagcatttgtagtcataatttgggtgactt | 26040 |
| aacccatatgcacgtgctcagcctaataatgtggtcactttccctgttctggtgtccttgtagggtttt | 26110 |
| cctctgaaattgagggagggtgggctgagctctgaagcattcttgcaacatcggccagagtggtctcacc | 26180 |
| tttatgcttttgtgatatgtgtgagccatgtaatattccactcaacaaaagaagcctggaaatcattaga | 26250 |
| agagaggaccaatacgttcttcccaagagttacagcctcaattccatgggtgtgcatttatgtgacatgc | 26320 |
| atctgacattagtggggagttcaatgggtcactataatttccctgaagcacacctgctgaaaaatgtcaag | 26390 |
| ctatcttataaatgacctgtatgttcttctcccctttggaagttagaggagttgctctattttttggtaca | 26460 |
| tttgctattttatttctttttttctaacaatatttcttttctttaatgctttatgaaggattttatttga | 26530 |
| aatgataaatggaacacatcttatgtatcaagtcaaaagttcataagcgtatatattaaaaagaaagca | 26600 |
| tcatttccttttttcgagaatcaacacaccttgatgccagtctcctggtttcattagaatccctctcttct | 26670 |
| cttcctctaaccaaaatgtctcagattccccgatttgatttctgtaaatggcctactttgactggaaga | 26740 |
| attgcctctctctgtctaaaacaggacccaggcgttactaaaacaaaacactgcaaaagttaaatgagg | 26810 |
| agaaaggaaagttaagcattgtacttagtgagaaatacataaacaaaagtagagacgtaaaagaagcatg | 26880 |
| agagaaggggtgagaaagtgaaatcctgagacaagatgaatggtgtgtgagcactcaaacccaggaagtag | 26950 |
| caaaaggtggaaggaagaatgggagcctttagaataagattctttgtgggctgggtggcagatgttatcg | 27020 |
| gtaaagccagcctggggagttggcaggggtccatgcagtagataacacagcaatagagtgaacacattgc | 27090 |
| agaagatagggcaacctctaatccagaaattatcagataaagaaaaccaagacactttgcaaaacaaaa | 27160 |
| aaaaaaacaaacaaaaaaacacaacacaatgtcttgtttttcatcatcatcttctttataatgaggtttc | 27230 |
| catgcattgaatacacacttggaaacactgtaatccatggttgttgtggctgcagattgataggtgtgg | 27300 |
| acaggtctttggtggggcaaacaaaaccaggatcatgttttttgctctcagaatgatcgtttgcttggac | 27370 |
| tttcctcttctgcctcctagtggctcaaaatgccactgcattcattggatttattcaggatgtgaagaa | 27440 |
| ggtcaggggaaattaaggatgagtgctttgtcattaggacctgagaggcaaatggagcagagatgggac | 27510 |
| gactgcagtgggataaggactctctcaccaggaaggtgccattgatgtaatagttgatgggaacagcaga | 27580 |
| gcaaagaggctccctcgtcctcagctgactcaacaacaagcgagacatcagatggaacggtatttattgg | 27650 |
| gcaaggaaaatcaggggaaggctaggtgcagtggctctcacctgtaatcccagcactgtgggaggccaag | 27720 |
| gtgggaggattccttgaggccaggagttccagatcagcctggacaacctagtgagaccctgtctcagaaa | 27790 |
| gaaagaaaggaaagaagagaggggactctggatgaccaaaggacattatgttaagtgatacaagccagaca | 27860 |
| cagaaagacgaatatcacatgttcttacttatatgtggaatctaaaaaaaagtcaagcttacagaagcag | 27930 |
| agagtagaatgttctcttacagaacttgaagctggaggtggagaggaaacgggagatgttggccaaaggt | 28000 |
| tacaaagtttcagttggcaggaaaaagtcaaaagatctgttcaatatggcaaacaaagttgaatcacaag | 28070 |
| gaattgaatatctggacgtctctaagaaagtagattttaagcgtttgcaccagaaaaataagcatttgaa | 28140 |
| ggtatgcacttgtgaatcagctcgagtaagcatttctcaatggagcatatttcaaacatcacttrggaca | 28210 |
| tgat | 28214 |

>HNL4 Exon3bis (29948-30058)

| | |
|---|---|
| cacggagctagttcatcattgctttgtcattaggacctgagaggcaaatgtgagcagagatgtgggacga | 70 |
| ctgcagtgaggataaggactctctcaccaggaaggtgccattgatgtaatagttgatgggaacagcagag | 140 |
| caaagaggctccctcgtcctcagctgactcaacaacaagcgagacatcagatggaacggtatttattggg | 210 |
| caaggaaaatcaggggaaggctaggtgcagtggctctcacctgtaatcccagcactgtgggaggccaagg | 280 |
| tgggaggattccttgaggccaggagttccagatcagcctggacaacctagtgagaccctgtctcagaaag | 350 |
| aaagaaagaaagagagagggagaggggagagagagagagagagggaggggaggggaggggaggggaggag | 420 |
| ggagagagagagagagagagagagagagagagaaagaaggaggaaaagaaaaaaagaaaaa | 490 |
| attagccagatgtggtgatgtatgcctggtgtctcagctacttgaaaagctgaggcaggaggattgcttg | 560 |
| agcctaggagttcgaggctgcagtgtgctgtgattgcactccagtctcagcaacagagtgaaatcctgtc | 630 |
| tcaaatttttaaaaaagactcaaaagaaatcaagggagggagtggagacaaggtagaaaagaatttttt | 700 |
| ttattttgtgcttttttccctaatgtattcattaatcatcaaataaaaattgaatatattgatcatgta | 770 |
| caaagtgatgtttgaaatatgtatccattgagaaatggctaaatcgagctaattcacaagtgcattact | 840 |
| tcaaatgcttattttctggtgcaaacacttaaaatctactttcttagagatgttcaaatattcaattcc | 910 |
| ttgtgattcaactttgtttgccatattgaacagatcttttgaactttttcctgccaactgaaactttgta | 980 |
| acctttggccaacatctcccgttctcctctccacctccagcttcaagttctgtaagagaacattctactct | 1050 |
| ctgcttctgtaagcttgacttttttttagattccacatataagaacatgtgatatttgtcttttctg | 1120 |
| tgtctggcttgtatcacttaacataatgtcctctggttcatccatgtagtcccaaatgacacaacttctt | 1190 |
| tccttttttttgaggtagaataatagtcccttgtgtgtataaaccccatttctcttattcattcatctaa | 1260 |
| tgatggacattcaggttgattccatatttcagctgttgtgattagtgctgcaatgaacatgggagtgcag | 1330 |
| atttctcttcaaagacttcttttttttccaatcccaaatacacaaaattatcatctggcatctgtcatgcta | 1400 |
| tggagactctccttgatctatttataaacgattcaggatttcttaaagaagctgaaattttattttttac | 1470 |
| atgcataaccatatttagaaatcaaaatattcaaacagaaatcacagaagaatctattccatcaatatat | 1540 |
| aattcccagttaattgattatataatgtcatttaagcatgagttagtagtcacagagaatatgccttaaa | 1610 |
| aatgtctgtctttgaaagttttacattcaaacagtctcttaagattattaattctaaaagacaccatc | 1680 |
| cctttctctcagcctgtttttcttcattttgcttctcatccagtatgtgaaaggttgatgattttttag | 1750 |
| ttgatgaggttgacgtgccctcttttctccttgggacagaaggacataagttgtgcttaaatgaaaata | 1820 |
| agagtatgatgagtatcccaagggatgatggaaagttccaggggagaagcattgaaattgagagccaaatt | 1890 |
| caagtacattggaattagggttctggtgataattctgtcagtatctacatatattcaaggaaattagtcc | 1960 |
| tttcgagtaggataatggaaaaatctctaaaaggcaatctgagcgggatgtttaaagactacgtgattat | 2030 |
| tatgcagtgcatgcctgtaccaaaacatctcaagtaccccacaaatgtatacacttactatgtacccata | 2100 |
| aagtttaaaaaaatgtaagactactacacatattctggcctgcagcttttttttcccctgacatttgccta | 2170 |
| cccgcctgtaatagcacaggcaattctacaagaagcatgaatatgcacatatgtacatgcatgacagcag | 2240 |
| tgatacaaagacagatgtgttgtgttctagtataattgtcttattttttgtccattccaacgttaataagt | 2310 |
| cattagctttatggaaatgaaccctaggggatgaaacatacaggtgcaaagtaaatttcctagggactaa | 2380 |

```
attataaccaaattatggcaggtacaccctgcatttagcgatataaatatatgtttcaaataaaattgta    2450
acatattgattggcacgtccagccatattcttaagatacttatccttggactaaaataataataatcg     2520
cttttttgaatgaagtgtttaattttcagtgtaaaaagtcaggaatattttagaatgctcaacgcaacat   2590
tgcttcaatgagctagggcctttatgaagataagtcactagaaagtctgtgttgattcggttaattattt   2660
gagattgtatgcactgattttcactgtgttaagtatagtggcatttattagaggctcagatgttatagag  2730
agaaggctgtgtccagttataggggctgtagtcataaacagatgggtaaaatcaacacatcattgtaaatc  2800
ataaacaggcaggtatgataaacacataatgataagcatttcagcactgggtgcagtgttgcatgcctgt   2870
agtctcagctactcgcgaggctgacgatctttggagcttaggagttcaagagcagcctgggcaacatagt   2940
gagaacccatctttaaacattaaaaagaacaacaaaaaaacatcatttcagtgtagacaggcataacatg   3010
atctcacagagaaacactacgatttgtacacagaaaactaagctttgcactggtgttgggagaacattt    3080
tggaatgataaactatttcctgtttgttttaagaaatatttggtaaggtttaaagtagtgtctgcctctt   3150
tactaaaatattccagtatctgtttagatgtcccagttggtcttagatacttggtggtaaacatatatat  3220
acacatatatagcgcatatatgtgtatatatgtgggtgtgggtgcatatggggtgtgtataatctatgtgt  3290
gtatacatacatatatgtgtacatacatacatatgtgtgtatacatatacatgtatcagttgtttgccct  3360
tgtgatgcacacacagatctatatgtgtgtatatatatgtgtctatatatgtatacatgctaatgtgtat  3430
gtatacatatataaaatatgttccttgattcacagtggggattatatcccaataaaaccgttgtaaatgta  3500
agatgtcattagttgaaaatgcatcaatacatctaacctaccaaacatcatagcttagcttggctgacat   3570
tgaacatacttataacacttacattagcctacagttgggtgacatcatctaacacaaatcctattttata  3640
aataaagtgttgaatgtttcatgtacactgcagagtagcagttgtttgcccttgtgattgtgtggctgac   3710
tgggagctacagaccgctgcctggcatccaaagagactatggtactgcatattgctagcttgggaatata  3780
tcaaaattcaaaatatgattctactgactgaatatcatttttgtatcatcttaagatcaaaaatcataa    3850
atcaaaccattgtaagtccgggaatgtctgtgtaataatttggctatagtcttaaacaggtgggtagaat  3920
aaacacattattataaatccatcctgtgcttttgaacacatggaggctaccccaccaaaatgcctgtgtt  3990
caatatattgcgaacctctaggtatcttttttccttcattgctgtttaattttccttctaagcatgaact  4060
tacaagattacttaggaatagcattcatccttcttcattcctctttgtttaaaacatgcttagcatttct  4130
catcttgaaagaaatgagtagctttcttcttttcaatcatatttcatcagaactatctcttgacggcca   4200
cagaaatgtcataagcattttctctggcacttctgatacttttaatggcttttgatacatcttcatgttt  4270
cttaatcttcttgtgatccttaccatgtaagtgaccgttgagcttatctccaactcctattttcattg    4340
tctccttccttttatttgaaacaacttacatccagcgtgcacgtttgaagtgtgcaattcaatggcctta  4410
gtatatgcacaacattgtgacaccagcaacaccatctaattttgaacattgacgtcattccaaagagaa   4480
atcccatacctcttctctcccaggtccccaggagataggcttccactaactatctacctgtctatataga  4550
tttgccttttgggggcatttcatgtaaattaaatcatataatacatgcttttttgtgtgtctgacttcat  4620
tcccttaatgtttttgaggctcatccatgttgtagcatgcatctctactcttttatttttatggttcgg   4690
taatatttcattttatggatataccacactttgtttatccatcctcgttgctagacattgggatcatt    4760
tccagtttctggctgttctcaataattgtgccatgaacgttcatgtgcaagtttttgtatggacatatat  4830
ttcattttcttgattggggatataggagccgaatcgataggtcatatcatgaactctgtgtttaaatat   4900
ttgagaatctttcaaattattttccaaataggtgtaccattttacattttcaccatcaatgcacaaaag   4970
ttttaacttctccacatcctcactcacacttgttctcatctgtcttttttaattatagccatcctaatggg  5040
tgtaaagtgatatcatgtttgggggtttattttgaatatttacatcattccaaaaagaagtcccgtatc   5110
tcttctctcctcacatccccaaaaagtaggcaagaggtaatctactcaagaaatgataccagcttaaacca  5180
gggcagtaccagtgagaatgcaaagaaaataaaaaagaaggaggttgttctgcgtgtcttacagatgcaac  5250
aggatttgctgatggattggatgcaaggtggcagagaatgagaatgcattttcctgatgactaatgatg   5320
ttgaacacctattcatgtgcttattggacatgtgtgtaaatcctttggaaaaatatctattcagatcctt  5390
tgcctatttaattggattatcttttcattactgaggtttaggagggggtacttttaagtagtataatgtg  5460
gatacatgttccttaccacatgtgggattcacaaacactccattctgtgtcttccacctccactttctt  5530
gatggcacattcttattactcatgtttctgaaaacataatcttcagcctcattgaccaatgactctgaat  5600
attgactcatatatgtttaagcaggcttgtccacttactatatctcacaagtcccatggttatcgtgaca  5670
gtccactgctatcccgtccctttgtggctgtctcatcattgtatggagacaatataaggatgccgggacag  5740
ataaagggtattaggatagagtgccatcaatgtgtctgtgaagaagggttcgtttcaatcagttcaccat  5810
gactgggggatttgattctgtcaattgctgactcaggaatgtaaatgctgagtaaggcaggacttgatcag  5880
tctattggggaggcatcattgaccaaagtgcagtgcaaatttattcattgactatgaggcatataact    5950
ctttataactgtcaatagaaaatggacaaggcatccctccgttccttacaggttttgtaatgagccctg   6020
gatttaaaaaaatactagtaataataagagaaacagaggggagacagagagagagagatgagataggtt    6090
tctagtttaagtgaagttaaaatgtttttctatatatacaaaactagctttgccaaggaagatgtagta   6160
gtggttttcattcattcattcttctttcattcaagaaacagatattgacaacctgctgtttgacacatgg  6230
tataacaacttccattgaaaatggagtagcaaacaaaacagagaaaaaatcccaatcctacagcatttc    6300
tatccagtaggggaaaaaaccaacgacagacaatatcgtaaaatacacagtagaaatatgatatccaagt  6370
gctatggagaaatatttagtagagaagggtgctaaattagaaatttttgtgccaaaattttgactaaggtg  6440
gttatggaaagtttcacagataaggcaaaactgatgtgagggagtgatccatacagttacctggaggaac  6510
agcatcttgggctaaggaaagatccagtgcaaaggccctgtggccacagagtccctgagaatatcagtgc  6580
agctggaaagtagtggtgaaggggatagtagcacctgatttcagagatgtcagcatgagccacattttat  6650
atgcctttaaaggactagtgtattgttcttagtgagaaaggaagtggctgtctatgtaaagggcatagg   6720
gttagaaggttgttgcataatccacccaagaaataaaaggcatttcgatcagaatttagctcttctactc  6790
catgaaactacttatcagttccattaatgccttccactctgcactctcagggttcgatttctggaaaat   6860
tttgaattttgattttgattttccagaacatttagagttctcgatgactctctccttcacgaaaacatt   6930
ccttacttggtatctatatttgtttctttcctattgctgctaaaacaaggtatcacaacttgttataact  7000
ctaatgttaacttagggaattaaaagcaagtgcagatttattatctcacagttctgggtgctaaaagtcc  7070
caaatgtgttcacattcaaagagagaatccatttccttggtttgtctgtttgtcttcttttgaagactgg  7140
ctacatatcttagatctcattctctgtttctaaccttccattttaaaaacaaacaaacaaaaaacatta   7210
tgattacctagattcatccagatgaaccgggttaagttctcatcttaagatcctcacttttttttttttt  7280
tctctctctgagatggagtcttgctctgttgccaggctggagtgcaatggcgcgatctcagctcactgca  7350
acctccccctcccgggttcaagtgattcccttgcctcagcctcccgagtagctgggactacaggcccgca  7420
ccaccatgcctcgctaatttttttgtatttttactagagacggggttttcaccatgttggccaggatggtgt  7490
```

```
tgatctcctgacctcgtgatccgctctccttggcctcttaaagtgctgggattacaggcgtgagtcaccg    7560
tgcctggccaggatgttcacttttttaaaattgattttattcttattttattttagagatgaggttttgctc   7630
tctcagataggttggagtgcagtgtcataatcatagctcactgaagtcccagcctcttgggtcaattgat     7700
cctcctatctcaccctcctgagaagctgggactacagacatgcaccaccacgcccagctaagttttatat    7770
ttgttacagaggggggtttcaccatgttgcccaggctggtcgtgaaccctaggctcaagtgatccaccg     7840
gcctcagcctcccaaaatgctgggattataggtgtgcttcctgacaccagtttctgaggtccttgacggc    7910
tgtggtcatagctcatactacctctctctcctagtgtctaccggacaataagcagtttctgaatgatta     7980
gccgttgcagggttttttgactccaaattgcaaatgcaagctaattaaaaaggagtgaatctatttact     8050
catttttttttttttttagtttgagtgaactgattctcaaaatcagtgaatgcccagtttcatgtaaacc    8120
gtgtttatttccactgtttacactcagcagctgtttcttttttcacaaacactggagattccatgttcccc   8190
gaaatatctatgtatacctgtatcataattcattacacataggttagctggaatggagatattttatatt    8260
tgtggcatgcatttgatcttgaattgaaacctgtagtttagaaaaatctacatatctttatattttaac     8330
agatttttgagaattataaaagcaaaacagtagagctctacggtagaattttttttttcttaggtctttcc   8400
atgggtattttaaatgtctcattatgaaaagaccataaaccatggttttctaagagttctgctgaatttt    8470
gcaattggctggcacattttctaaatgatcctgtaatctccatgtattagttttctagagcggccataac    8540
aaatgaccacaaatgtgatggcttaaaagagagaaatttactctttctcatagtttgggaaaccagatg    8610
ttcaaaataaacgtgttggcagggctgcctttccctgggtggttccagaaaaagatccttccttgcctt     8680
tcagctctggtggcctcggtgtttgtctctatcttccaaggctgtcttccctctattgtatgtgtcgtc    8750
tccttttcttataaagataccagtcattggatttagggttataccctcaattcaggataattttatctgc   8820
agatccttaactaattatatctgcaaagacccctattttcaaataggggtccacattctgagttttccaggtgg 8890
acatgtattttggaggatattacgcaacccactccacccaacacatcattattgcaatatatatgtatg    8960
aatataggtgtttcagatatttacactacacatgtgtgtacaaccaatgtattcaggatgccacctggct   9030
ttctccttactaggccacactctggcaagaagatctaaggacaatctgggattcttcatctccttcttgc   9100
atcctcttttgcttccaaataatgtagtcatgcagtatctgaaagttttattcctgagcctttaaaacttc  9170
tccatcagtttgacaaggagtaaaagcgttttcccgttggccacaaaacttgtgcttttgctccagca    9240
atacgcaaagctatatttcacacttccttcttaaattacaggctataaatataaagcaaaaccttttacc   9310
ttggatattcttctgtctttccctctgtgattaaatctgattacaaatgctcattaatgctctgcctt    9380
ggaattgcaatttgggcatgtgccatgtgaaaatggaggttcctaaaaattaaaatcaaagattaatgca   9450
ggttttaaaaaagggtcttattcaaatatatctcaagttttaaaacgactcatggactttttaatgaaatc 9520
aatggccttgtaatgcctcatttttttttttcaaactcaactgtttcatagccttctctttagaacatatc 9590
tgatttaccagaacccaagatttgtgagatggtgttattttttatctttacttttttcctcaccccacggt  9660
accatgaagagatcgtgtaacatcctttcctggttttaaagacaggtgagtaacgattacataacgttca  9730
aacaagtcaggtgttctccagaagatggtgttaatggtgtctgattcacagatgctgccttgacccctgg   9800
cggtggtagggacctatattctggtgaaagccaatttttaggccatgaattataggacctagatggagaaa  9870
acgataccaaacctcatgagatcttaattcactgatcggtgggagagatattttttctttcagatggtatc  9940
atcttattgcatctccagcagagtgtttggccggtgaaaataaaaatggccattataaagaagttctttta 10010
gacttttaaaaattttactaggatcatgccagaaattcctgctgtagaagtagatatgtatgtgtgtata  10080
catatatatatatatatatatatttctgaatttgagatgttgggtattggtagagattcattcatttgaa  10150
tggaaatacgcttgcttttactttggccagcatgaatgctctcatttgccacaggttggcaagcttattg   10220
gtttaaatataaaggatcttgtgggtaagactaacagcaggttttcatagtgccaacatttctttctttt   10290
ttattatcatatttaggaaagtctcttgactctgagatactttatattgtgaaataatagttctggtgca  10360
agtatagattaatagattattaaacactttaagatatggatggaagagtacaactaggatattattaatg   10430
agtcccattttactattctttaatttgcagtggaattttcatttaacttttgaatataccaatgatagg     10500
gttagtagtgttttgcctgtaatttatcctgagctcattttatttgaagttcaaatttgaaagcttccttt  10570
gttgtttggtaaatagagattattgtgattcaaaatgagtaatccctaaattgatgtagaaaagatatt    10640
tgaggctgggcacagtgactcacgcctgttatcccagcacgttgggaggctatgggaggtggatcacttg   10710
accaggagtttgagaccagcctggccaacatggcaatacccgtctctactatgaatacaaaaattagct   10780
gggcatggtctcacaaacatgtaatcgccagctacttgggaggctgagacccaagatcgctggagcctgg  10850
gaggcggaggttgtaatgagctgagattgtaccactgcactccaccctgggcgacagagcaagacttcgt  10920
ctaaaataataataataataataataataataaaataaaaagaactttgagatattcatattgtcca    10990
aaaagtataattcaaatacttaatgcagaaggcagtaggatcactaaactacagactcattcatcaatta  11060
taacagatggaagggtctttgttagagtcctggaggctgattgagcattttaaatggcaggttcataggg  11130
gagatccaggaggtctaaaggtgagggtctacaagcaggaagcaccccccactcccaccccccaaattcatg 11200
acaacaacactaactaggcagcaaagggatatttcctgatgtcagcagtcagcagaatggtactgaaggt   11270
tgctagataaatgcaagttttgtagtcactcacctgcaagttataggcaagatatttatctgtactccta  11340
caggaaattagccctaattgactgctcttaatcagaacaagacattctaacctcttattcatggttagca  11410
gtatatcccacttgcttcactttgtgattctccatcacattggaataactggacgtgggatacatttgga  11480
attgagtctcaaattcaaatcgccatagaacctgaaaagaaaattgtaagaagagacaaaacagaagaaaa 11550
atgcaggatagagagttatgatttagatgtgttcattcgtgaacagagagcagattctcttggatctgg   11620
ctgaaacaggggccccctgtgttgtgaaagtggtgtatgtcttcatacgtgttcccacgggcctggacaa   11690
ccaaccacatttgaaaatgaagaaatgaaagcttgtggtcagggtcacaaaacttgacagtggcagaag    11760
tggatccaattccagtcaaatctatgactcgttccatcttggccacaattatactgcaactcaattgct   11830
ttcttccagtcagtacccacccaccgaaatgtcagcctctcaaggcattaattgttgtttgtttcatt    11900
cattgttgagtcttaggagcctgggacagtacattgaaaatctcaattgttgacattctcaataatacac  11970
aagaaatcatgttttcagatcatgaaatcatatccattaggatggctgttaataaagtaaacgtaaaat   12040
aagaagttgtaatggagatgtggagaaactggaactctttcacattgctggtgggaatgtaagatggtac  12110
agtcattgtggaaaactctttggctgttcctcaaaaaagtaaacatggaactaccatatgtgatccaaca   12180
attctacctccgggtatatactccaattctacctctgggtatatactcaaaagaattgaaagcaggaatt  12250
ccaggagatatttgtatacgcagtcctcaaccatgttattcacaatagctaaaaactgaacttttgaact   12320
agccaactatccattgatggatgaatggataaacaagtgatatatatgtatatatttatgcgtgtacaca  12390
cacacacacacactgctgaaatggaatattattcagcccttaaaagaaaggaaattctgatacatgctac  12460
aacataaataaaccttgaggacatcattctaagagaaataagctacatgctagtcacaaaaggacaaaag  12530
ctgtatgattttaccaatatgagggtacgtagagttgtcaaattcacagaggcaaaagttgaatggtgtt  12600
```

FIGURE 8A-44

```
tgtgtgcggctgagaggcggagagaatggaaaattatttcctaatggatagagtttcagtttggaaaggt    12670
acaaaatgttctgaagatagatggtggggacagttggacaataatgtgactgttcttaaggccactcaat    12740
tatacaccaaaaaatagtttaaatgatcaatttcatattctctatatcacagtaaaataaaacattatgg    12810
tatctgtgatttaattgactatttgtaatcatcaccatgttagagcatgttcagtatctccatatcctgca   12880
atattggaatggacatggtaattttgagtggtagaaaataaagtaacttttaaaaacccatctctatgt     12950
attcacataatcttacatttcatataagtgaaatcatacactctatatctcatttctttctcctaataaa    13020
atgtttacaaggtttacaaggttcatccacattgtagcatgtatcaatcagtaccgcatgctggtttatg    13090
gctggatactattccattgtatgatagaccgcattctgttatgtttatctattttcatttgatggatat    13160
ttggattcaattcatagagacagaaagtagattagtggttgctggtgcttggaagaggactataggaat    13230
tagcgtgtcatggttacagagtttcagtttgcgaacatgaaaaatttctagagatagattcacaaaatg    13300
caaatatactaaatgacattgaacagaacagtacacttttaaaatggttcactttatgttacgtgaatttc   13370
ctcttaaatagaagaaaaataaagtctgaagttgtcatatccttcactgggatgctctcttaaaagtgt    13440
agaaaggtcctgaaaggagcatataaacaaactaaacaacaatcaaacaaaacatgtcatcgtaccccac   13510
agcatcctgacatggaagactaaaaactgtcccagggctctcttcttcctcttacttgttactttcagggc    13580
attttagcttaggatttaatttgactattgacaaccccagtgtctccatttgatctcagagcaaacttga    13650
attgataattaaatttccatgcttttgaccagggaagactttaggaaatgtctttgaaactgtgaactt     13720
gcagaaaggagaaaattttatatgtatctagcttctatccattccatttgtcatatggtcagaacttaca    13790
tgatgcaagcaggccatttacagggccctgggctgacagctacatgctatattttgtatttgcttccact    13860
attttgttagcaaatgtatgtacttactaacaaaatacgtgttttaagaaataaaattatttaagaaca     13930
aaataatacaatgtttaagaaaacctgcttttatttgcttttttatttttttatttaaaaatgtttataaa   14000
tttatgggtgttacaaattcagttttgttatatgggtatattcatagtggtgatgtcgggcctttagtg    14070
tactcatcacccgaatagtggaacctttatccagtaggtagtatttcatccttcatgccccttcctcctc    14140
cttccacctcctgacactttatagtctccagtgtctattattctaccctgtatgttaatgtgcacctgtt   14210
gtttagctcccacttataagtaaaaacatgcagtgttggactttctgagttatttcacttaggataatgg   14280
cctccaccccagtttcatacatgttgctgcaaaagacataatttcattctttttttatgactactactgagt  14350
tgtattccatggatatataaaccatggtatatataaacatttatatatccagtcatctgttgatggacac    14420
ttaagttgatttcatgactttgctgttgtgaatagtgtagtgataaacatatgagtggaggtgtcttttt    14490
gatagaaccatttctttttcctttgagtagaaacccacaagtgggcattgctgggcaaatgatacttctat   14560
cttaagtcatttgggaaatctccatactatttctccatagaggttgtattaatttacctccaccaacag    14630
tgtataactgtaccttttctcagcatctttgccaacatgtgctgcttttgacgtttttcaaaatgtca    14700
ttcatttcatttttattataattacttaaaaatgatgacttttaacagagaagggaaaaataaagttgg    14770
taatcttttgtagtgccatataatttctagttacaagaccacagataagtcccatgctgaagagaggtgg    14840
gtaaaatagctcgtttgaaatgaagcacatttgggaagataaaattgttttaggatgataacgatgttt    14910
gatgtctaactttggtctagtttttctaatgttaagttgattcttatatgactttgcccaaattattcactct  14980
ttaaaccacatgccaaaacattacttacatttacttggtttataataaaaatttgggactattagtggatg   15050
atatttactgcaagaattgttaatctggcgtttggatctagtatttagattacttttatattttcagctgc   15120
atatgcaactattagatatctgcccacacttttttccttcccactgtgaaaatacacactgtattaaggt    15190
gacaggttttcctattttcacccttagacttgagttatttctcatcattattaactcatagaacctgt    15260
gctttgttcctggcttcagcttgagcactgtgcaaaaattatcttataagattggtcaaaactgttgg    15330
ctgtgtaggcacttccccctagtagaaacttcccctttccctctgagggttcactgaaaaatcaacttaa    15400
aaaggcagattaattgaagaaaaggcatgcadatttccttaatgtggatagcttggcaggaaggattag    15470
gagactgattacccaatatcttaatggagtagatatgcttatatactctacttcctagaggaaagggagg   15540
tgaggactcctggatgatacttaggggggatagtaaatgattttaggggaattaagtgggcttgaagaac   15610
atacagtggcttagaacaaagtctgttgggcttgcagacagacagtggtttgtcacaaaagtctgtcca    15680
ggtgtgttgacagacttcattcttcttcctgcgatatgagtccagttactagaatctcggggaagggac    15750
cagaggtcattgttttcttctttgatgggtccagacttaggcagataaacaacttcagaaaacaacttc    15820
ctcctgtgctttgggggtcacagagggttgagagacaagagggagtgggagaagatgagagagacgttga   15890
ggcttcttcttcagttcagcacatcaaagtgccataattttgctgtatgggtttatgagtcccaactg    15960
ggtagtgaagacaaccccaggcgctgtgtgttgatggttccgctgcagacagtcaaggctccacttctctggg   16030
aggaagctaaatgccactcagagacacatcccctcagatgtctttgttatatgatgacagttggca      16100
cccagatggcatgtatcccttgtggtttcaaccattggttgacatgacccttaaaggcccaaggtatgtat  16170
tcgttggtccatttttcgaggaatgccatttttacttccacaatgcagcatagctgttaaccattcatca   16240
tgccagtaagagaatcccccgggatctgcattgggacagaatccccattcactgccttgtctcacttttgt   16310
agtttgttttgttttgaatttgtttttagttttaacaaataatctgaagtaaaatacaattgaaa         16380
gaagcacttatcttatgatatcaggataagtaaactagtgcagtttcagaaacatctaaccaagtgttgt    16450
tttcttgctggattgcaatattgataggcacatgggataatatctcatgtaaattctgaaacatctaatt   16520
gcatcttgatccttcatcttgaccctcttctcagtgggctgcatttatccctaaacagcaacattctgtc    16590
aattcttaggaacgtgaaacgttacagtctgcagagcaaattaccagcaggagaaaatattactgaatat   16660
tcaaaagcatgcctttgtgtgaatgatcttgaagcccccagggaatgggggaaacaggtgtgggagtaca   16730
taagccaagaacctatttgatccagcagtttccggcttctaaaaccctacccgtcagttccaagaaga     16800
aaataacaaattggcatcacttaatgtttagtgatagaagaagaaaagcatgcctttgttcatttctac    16870
tcttctcatttcctgcttcaccattcctatcaaatgaaacatttcgttttcatttcctctctataacttg    16940
tactatttctgtgaatagatgatgtgcttaacatattgatgtttgtgagtaaagatactcttgctatcat   17010
caaaagaaatagtatccatttggaagcatctagtatatgaggaaaagttttgttttcattttcccctta    17080
tgtgtttttttatatttttaaatgtagttgtaaaatgacagaacatgggatcacaaagaaacacaaaattc   17150
gtaattaataaatgtgattttgtatttattttaggtatgcaagggggcacgtttgtgtgggagttcaaaag  17220
catttaaatattttaaatctccttcattcatttaataagtgtcttttgaggtcagatgtaaacagacaa    17290
cttgttacacatgtttcttgttttagggaacttccaccccaacatgggaaataaacagagaccctacta   17360
gttcttttaacagtttcttaatgaaacaggatatttccctgacccccttcacaggtgggaactgggagtgac   17430
tggtgctggaactagccggctgcttccaggccagcgggggtgaaccctgctcactcgctgctctacccct   17500
tgtgggagggaagcacaggtgagcaggtacaggagccagggcgaacaattttgggcaccagcaagaatg    17570
aactccataccagccccacggcagcatctagtagagggtagccccgcaaccccctgaagacccagaggaagt   17640
gttacactgcctgtttggctttgccatccgcagagaccgtaagtgttaacagctcagtggagggtcaatg   17710
```

FIGURE 8A-45

```
tgacagccttttgcacccacactcatggcacgcaagtttttgtcctgaggtgggaaattaaagaaaaata    17780
aaatcaaaagaaagagaaataagttttcctgtattaggctgactttccccagaggcagcaacaggcaca    17850
gcccagacccaggaaaagtcttgataatattatctaatgtgctctggagactctcccagcactccctcaa    17920
catagggagaaggaaaacaaatttcgtttgttttatggaatgagtttatagattcctgttctctgtaac    17990
taatgacttcaagtattctgttttatctaaaaagtacaacgaaggtcatgagaagcctgattaggcctga    18060
actacagctgcttgggcaccatagtgaaggttatgaaataaaccagtgcaaggcactttagagcaaacc    18130
taggtaacagacatctggattgcttggcaatggtcatatgcggtcctgagtttgtcctgcctctgtatcc    18200
ctgctttcacgccactgtaagcttacttcaagctagcccaccccctttgttaagtgtgtatgaaagaca    18270
agtgctgtctttgttccgggcccagtcgttggacgttgagtctgctgggtctgagtgcactcaataataa    18340
agatatcctcctgtatacaccccgaggtctctctctggtcctcctgatcccgcaacagactgacgtccag    18410
gagcaatcaggtcacacgaacaaattgaagatggtaaatgcagggggatttttattgctggttgaaagta    18480
gctctcagcaggaagggaactgaaaacgggatggagcaggaagataatcttcccaggagtcccgtcat    18550
cccccggccagaatcttctccaaagctatgccatcaagctgtccctctgaagtcaagccacttctctctga    18620
tgtccaactataatttccgatgtccagctgcttctccccttttccaagctatgcctggagttttttatggc    18690
acaggatgtggtgcagggcaggccatgggtggttttggaaaaggcagcagtcgagtgggaaaacaggaat    18760
gtaaattctcactttgggccctggttgcttttggcttgagggtggggcacttaccgggaacccgctctc    18830
ttctgcccagaatttccctgccttctgtccctatcggttttgtatttattttaggtatgcaagaggcacg    18900
tttgtgtggaagttcaaaaacgtttaattatttaaaatctcctttttattaatttaatgaatgtctttga    18970
gctcagatgtaaacaggcaagtacagctttatagctgcagtgaatgctgagaatgaagtactcaaacaatt    19040
ccagctgaacgggcggggaacagctcttctgagagagtgctgcccaagatccatccacctgaatatttt    19110
attgagagagcttgttttaaactacagttcagatgaacaaaagacatccaccaggtggctctttgcggtttg    19180
ggtcatgaggcacatatgaccttgtaaaaaacactcaaaccacattcttaggaggctgtgttcagcactc    19250
cttatcacacatactactcccctgtcctgttttcagggacaaggagttctagtctcatgcacaaacaacat    19320
gcacacagtgcctcagtattttttccatgcctcgacctcacgtgtcttctacattagcttgaatatgttgc    19390
catgcaccccccacaggaagtcattacacatgtttcctgattttaggggagcttctaccctaacatggga    19460
attaaagagagatcctactagttctttcaagtgtcttaggtaaccaattagatatattctacaccccctta    19530
gtggcaagtgctcatgttgtcaaatttgcatttgttttcaaatgagattaaaacacaacaacaacaatgt    19600
ttaaatgtttctactattagaaaataaaatcaatgtattctatcttgatttttcctttattctttata     19670
gagttctggtttgcaacaaagtttttatcagtagcttatttaccttcccaagagctcgggcaggatttgat    19740
ggtgaatgtacattagtggtttccatatttaaaaaaaaaaaaatgactctgaataagctcccaggct    19810
ctcagtttcttctagttctttctgaaatggtccacaacatgattgttttgaaattgaaaaattaaatgct    19880
tttatttcaaaccccaccgatctaaaaccagtaggtgtacctttcatgagcacacttcattctgcaggtg    19950
aaaaattttcttccaacaattgtctatgatagtgatttataagtcagcaatttgctctaaagaatgtgtc    20020
tctttctaagcatcacaagaagtaatttaaattatgctgtttcttagtaagcatgttgattgaacctcac    20090
atatttccactgattctacactaaacacagactctcttttagttgtactccatttgacttggtttataca    20160
gttcacatagtcactttgtatgtctaaacttgcctgaccattttactagatggcatggtgatatggttt    20230
ggctttgtcctcacccaaatgtcatcttgaactgtagttcccataatccccatgtgtcatgggagggagc    20300
cagtgggaagtaattgaatcctgtggtggttaccctcatgatgttctcatgatagtgagttctcatgaga    20370
tcagaggattgtgtaagggcttttcctccttttgctcagcacttctccttgctaccaccatgtgatgaa    20440
ggacatatttgcttccccttccgccatgattgtaagtttcctgaggactccccagccatgctgaactgtg    20510
agtcaaactttttttccttatacattacccactctcgggtatgtctttaatagcagcatgataatggaaa    20580
ttgctactgagagtgggggtgctgctgtgaagatacccaaaaatgtggaagtgactttggaactgggtaac    20650
aggcagaaattggaacagtttgaagggctcagaagacaggagatgtgggaaagtttggaacttctaga    20720
gacttgttgaatggccttgaccaaaatgctgatagtgatatggacaatgaagtccaggctgaggtggtct    20790
cagattgatatgggtaacttgttaggaactagaataaaggtgactcttgctatgttttaccaaagagact    20860
ggaggcatttttgcctggcgttgttgttccatgattttttttttatgttcaacaggacgatggcacaacc    20930
tagctgcaaggcacagaccaactcccagcattgccagggcttagggtacattaccagtcagctgctgac    21000
cagcagggctgcttttctctttttgtgagtaactgagaattaaataaccaaggggataacctaagtaacatggcctcaaatcc    21070
tgcagagggttggagataatactggagtctcaacatagactatatgggaaagtctagcccattaatctcc    21140
aggcttttttctaagaaaccaaacgccaatattttatttgttgcagaaaagggacatcctgtggtcaaca    21210
caatcttcagtgggagttaattttaatcaggttctttagaattcaggaaagctggaaaaaagaggagttg    21280
tgtaactcacatactgggaggcatcttctgtggccagtcagcagataccatctccattggagagatgcag    21350
gcatcttaaggatgggagaattccattatagcctaggtttgtccatgggcctggcttggatagggga    21420
tggcccatattaatgtctttgactcttggttttattgttacattctgtatggctgattcagatttgtcca    21490
cactgatatatttgttctctgattctgatcattgtggccatcttttcctagaacaaagggcttaggttaa    21560
ttttttgcggagtaatgacatttttctgtggcagccaaactccgtagaacaatattgctcctacttcttgtt    21630
ttcttccaatggtaattgaacgtgcaagccacattcaggagtagggtctgaaattcccaagagctagcc    21700
agcgataatagtgcaaatctaatacatgcccttgaaacaccaaggagtaaatcatgtgcatgcctcaaatcc    21770
ttgggggtttgaagaaccagatgacatgcaaaagaaaaatattgacaaaagatatctcatcgtttactttc    21840
aattattgagtttgattttcatgcattcaaccttagtttttttaagaggtaagtgattctagtttgtgag    21910
agccagaagcatgcacaaataaaccttatttaacaaattaatctcatattttcttggttctgatgattgc    21980
atactgcttatttaaaaaggttgtgagcaagccaaagttatcatacttatttttaaagtgacagcatgg    22050
ctgagctttcaaaatatgtttaaagattctaaggagaacaggttagaaaacaagatgattgacagcttt    22120
tgggttattagatacagaaaattatacttagatttatttaggttgaaaattaatcctacagcatttaaac    22190
cagctgggagagcttgtgcatgcacaagagtgttcaagctgcaacttaaggccattgggcaacagtagaa    22260
agaaaaaatggttatttcttctctttcagaaccaactgtgactgattaaccacaaaagatcagtgggg    22330
tattcaggcctaggtcgtcttggtggcaactgggggttttagtttgctttcaggctcattgctggaaaagg    22400
ctgttcagaagcttcctacaacaagggagatgacagttgcgtgagtacaaagcagagaggtgcagtgct    22470
ttctacagcaccgagtgggcaaattgtgcagattttttcagtagaatctacttaacaccaatccatgcatt    22540
tgcattttattaaaatgaaactgtgatcatttcaactgcacattgcagacatgccctataaaatgtttga    22610
agtcctgttttggacaaaagttttgaaaacatgcaccccgtatcaatttctctacttatattttgtattt    22680
aatttctctaaagaatgccacattttcaaagcaagcaggccaagagaatgatcttttttttcctctttttt    22750
ttccccagtgtttaaaatgcaactgccatggggctgtgccatttttagctgttggaaaaaataatctacta    22820
```

FIGURE 81-46

```
tgccttggttgtatgtctgagtcatcagagcttctgggaatgattctttggcacattctaccaacaattt    22890
aacatgacacaaaatcattttcatatcttgtgatagtgtcagccaagtgtttcatacacatggtgctagg    22960
tgctgaaaaaggtgtctgaataaaattgttttcttaaagqaaccataggggacatgataaaaagatgcac    23030
aattatatatctttttttttttttttttttgagaaggagtttccctcttgtcgcctaggttggagtgcaat    23100
ggtgcaatcttggctcactgcaacctctgcctcccaggttcaagtgattctcctgcctcagcctcccgag    23170
tagctgggattacaggagcctgccaccacacccagctaatttttgtattttagtagagacgaggtttca    23240
ccatgttggcctggctggtcttgaactcctgacttcaggtgatccaccgcctcggcctcccaaagtgtt    23310
gggattacaggtgtgagccactgcgcccggcctaaagatgcacaattacatttcataaattgagagagtt    23380
tcctaaacaagagagagcatacctggaaatatcagagaaaaatacaaagggcttaaagatgttgtattaa    23450
gcaaagttagactaaggcagcttggatgtgcatctcctccactttatgtttatacctaagtagagattaa    23520
aagcagaggaatttcaatttccacatgacttgtatatgagcaacagatgggagttctaactactgaccac    23590
attggcacatcacacaatgtttctttcaggtttctctacctatggcaaaaccagtgctgtattagagcc    23660
tcgtgagctgtgtgttgttgattaattgacttaacctctctgggcctcattttctcaccttaaaataa    23730
atgagtcttatggtgttttgaggatcaaaagagttactgtacaaacagtgctagtaagagtccctgccac    23800
atggaaaggctattatatatatatatatacgtgtgtatatatatatatatgtgtatatatatatgt    23870
gtatatatatacacacacacacacacacatgtaatttatatattaaatgtgtataatttataat    23940
ttttgtattataaatgtaaatctgtgatatatattaaaactatgaaatacagatcatgtaatatatacta    24010
cctattgttttttttttaatttgtaaccatattttgaaaattttattttgcttataggtcttgaaagtca    24080
ttccccaatcaacctttattaaaatcccttttgattcattggagaatatcaatacatatgaggtattaata    24150
tatataacatatgtaactcttctgagtttataaatctatgtataaaacataaaaattactaactcttcat    24220
atatatgtttgtatctatatataatttatatatatagatatatatacatatttgtattacatatgaataa    24290
tcatcacagtgtgtctgcatttgttaatctaacctcctccaaccccaccccaaaaaagcagaaactaaa    24360
aatagaggaatttaagttccacatgattttatataggagcaacaaatggaactactaacttccgaccgca    24430
ttagctaatcatacaattttttttcttcgtgcttttgttgtaaatatgattttttattaagagggtatta    24500
ttgattatctacgcaagaattagccatgttctccatacttctacttcagttttttaaaaaaggatgagga    24570
tagaccgggcataagtggctcatgcctgtaatcccagcactttgggaggccgaggccggcggatcacttg    24640
agggaaggagtacaagtggcctggccaacatggtgaaaccatcctcactaaaagtacaaaaagttagct    24710
gggcatggtggcgcatccctgtaatcccagctacttgggaggctgaggcaggagaatctcctgaacccgg    24780
gaggcagaggttgcagtgagccaagatcacgccactgtactccagcctgggtgacagagcaagactctgt    24850
ctcaaaaaaaaaaaaaaaggtgaaaagggtgaggattgttatttctgtgggcaggcccacacagcatcag    24920
attcctcagaaactgcaccggtaaatgggaaagtctttgagtccctctgacagagcttcaagggggctggc    24990
tgttcattatcccacagcctcctttgctctgtgtaagtggaggctctgtgcctctgttatcttgcagtcc    25060
ctaggtgaccccggcaggagaaaaatcagtggaatcaaactcggtagcacagaaaaacgccccaaaggc    25130
aaggatgagaggaaagttgtgatcccacatatcaaagtcggactcttatctagatgggcacacctgagcc    25200
acaggctggcaggctgagattctgcaaaggctctggaccccagataagcttgactgattgcattgtgatc    25270
tcttcttttcatcaggggaggcgctgctttgaatgactaagctggatctgactttccagggaatcctttc    25340
agggactgtgaccatccagctatcttggatggctttgatgccctaattattttcacttggttgcagtgat    25410
actttaggtatctgttcatgtgtcatcttgtacagaaatgtgtgttctgggcttataaaaaaagtttaa    25480
ttgtaagacaaagggctctaggtttcatatttattcacagtctgatgaatggcacttatggatacgtacg    25550
tgtatacagtaagtgctcactgaatttctcttgagtgataaactgggatacaaaatgtcagaaaagaaag    25620
agtgaggatgggcactggatccagatgtcagtgaactctgagggtctcttgctggttaaaagaacagggt    25690
actttattttcattctaaaccctgcctgaccccttgcccttatatcagtgaatcaccatctgatggccc    25760
ctcaaacatggcatctttgaagtagagcctcattgagaaggactccttagaagtctgtcatggctactaa    25830
aattcatatctgtgctttgtgcctgagcactagtacatgtgtcagctgtttcttaagcctacattgaacc    25900
attaggtaaagcccagtgtgctcccagttcctaaaatctggtcaagtcttgatgttggtcaacatcttgc    25970
ctggccccagtcagatgtctccagctatctgtaacaggactcagtgtcttgtttacaaaatgcattagtc    26040
atatggcttcgttgctggctttgctgtatagtcaggaataagtcagaaataaccaaaatgctccaaatc    26110
aagttctagctgtttttgataccaacatcttccatcaacttcgctttctccctgactcatctgtctgtctgt    26180
tcctgtgctcttcgcacacagaggcaattttgtgtataaagctccccaaggggaagaagaggacagtgcct    26250
tcatgggaaactcctttctcttaaataggatttgcatacttaaccagagcatttgcttcagttaaccaag    26320
tgagaggtggagaaattcttgcaaaactatagctacattgagagggattattaaaagtattgactcattc    26390
attagaggagctgttacaaagattgtagcaaccaaagcaaaataaaaaatattgccaaaagtattctcaa    26460
acgtatttaaaatgtccaaaatattgggcaagactaacatcaaagaaggtatatgttttgacattgatt    26530
tactaactacttatcagtgtaagtaaatacaccttcaagcacttatttaggattaaggtagtcaagttat    26600
atgagttgtatgagtatgtgcaggccacaagggttgcaaaacatagtgaattcaatatccctctgccata    26670
ttgaatatccttctgccgaacttctgcatcacagttgtgcctgcaaacaggtaacagttgtctgccaat    26740
ccctagggatcactgcattctataggggcttgaccaggaagtaagaggctcttcccaataagcgatatcg    26810
ttatggtccttgtggttctgctaagaatctcagagaagaaatgaaagatacatgaaattgtttgcatgct    26880
actagctctagtgggtaggttggtagcgtagttcttcatggcaaaagacagaatatatccaaaattttca    26950
ccattttgccctggtttgagggatgcatattcctttagaccattatgttgaaaagaaagttaaaaataa    27020
cataagaagagacctcctaagttgttaatccaagccctcaatcttgcaagtgcctggtgtaaaatgtc    27090
tcattaggtaattacccatctcctgtctacccactaagaggttctagtaaagtacatactggctggattc    27160
aataaagcacaaataggcagcaaatgcttcttacatctcaatctaatcggtagccttcttatcctcacc    27230
cttggctgactaacgtgcataaagcataggaattctggccactcaaggatcttaaccatccagttcagtc    27300
tgttgcaatttctcctccattacaaatttttttcactttcctttcctgggaaagccacagacaggacaac    27370
cattcagtgagaaaggagtgtgaagctgacgtctttcctcactaagagggagggggccatgagaggaaaa    27440
ggcaacttcttcgctggctggtggtagagttaaagtctgatgctactgtcttctgggagcagcagctgta    27510
cacagttgaacttactttggaggcatatatgatttccagggtttctgtggcaagttccaccactgcag    27580
ttcatttgacttgggttgaatctctttcctccctccatcacttcagctgaacctcttctgtgatcctcac    27650
ctgttctctagaggtgagaccagggcacagtccctttctagatgaccaaagagcacttctttctatgtgc    27720
ttcacatttggctccatcaccatcgtagctgacagggccaaccctccggcatcttcatccttcaccactg    27790
tcttctgctgtgcccataaggcctgaacaaggctgatgggccaagtatggtgtggccagccccacagtct    27860
gttactaggccttgctttggtagacacacttcttgatttagaaccatggctctcagtcatgggcagttgt    27930
```

FIGURE 8A-47

```
gccctgcttggcaatgtaaggagacatttccagttgtcagagtgagtttgaagggtgttaatgcacttag    28000
ttggtggagaccacggttactgttcaacatcctacaattcgtaggacactcatccataacaatgatctga    28070
ttccaaatgtcattgatgctgacattaataaaccctgctctaagttaatgttttttttcttactcatattt   28140
aaaatgcttcctctagctaaaccattagcccccagtgaggtataagttttcctctccaagggacattta     28210
ctatgcatgtacatacttcgggttgttacagctggagattggtgatgcttctggcatctaatggatataa    28280
gtccaagatgttgctcaatatactgcaatgcagaggacagcccacgagaacaaggaattatcccattcat    28350
aatgccactagtattaaggttgaaaaaccttggtttagaatatgggggatacttattggtgctccctaagg   28420
tgctatctgaaagcagctttgaagacaagcagaggctttgaagacatactcacaggtatgatatagtttt    28490
ggatatttgtcttctccaaatctcacgttgaaaactgatccccagtgttggaggtgtgacttggtgggag    28560
gcatttgggtcattggccggatccctcatgaatgacttggtgcagtcttccaggtgatgcctgagttctt    28630
gctctattatttctcaggagatcaggttgttaaaaagagcctggcaccttcctctcctctctctcttgct    28700
tcctctctcaccatatgatctgcgcacacagcagctccccttcctcttccaccataagtggaagctccct    28770
gaggcctcaccagaagcagatgctggtaccatgctcttgtacaccccgaagaactgtgagccaaataaa    28840
cctctttttcttttcttttttatttttctaattagagacaagtcttgctctgttagactggagtacagtg   28910
gtgcaatcatagctcactgcagcctcaaactcctaggctcaagccaccctcccacctcaacctcccgagt    28980
agctaggactacaggtgcatgcctccatgcccagttaattaaaaaaattgtagggacagtcttgctgagt   29050
ttcccaggctggtctcaaactcctgacctcaagcggtcctcctgcctcagcctcctaaagtgctgggatt   29120
acagatgtgagccaccatgcctggaccgtcttttctttataaattgctcagcttcaggtattccgttata   29190
gcaatgcatatggagtaagacattgtacaagtcccactttgggcacgtctagatctgtctgtgatcctag   29260
acaagttatgtaatctctctttgtgtctaaacctgttgtttgtttctgtcttcttattcctcattaggtcca  29330
actctaaagatagtaaaattataggtataaatggagttaagaggggtgccttaccaagagtaaaccctcc    29400
aggagtgttattctgtcagtatgacttggttttagctttagcatgaaactaacatggcag              29470
gaaaaggcctaaattagaattcttcacacacaaaactccttctatcaggaggcagcccatctgttgtcaa   29540
ataatcctactcgtagaaatgtattaaattttttcttttccttccctttttccccccttcattaaatggaatt  29610
agattgtgacactatgaggaaattaaagtgaaggtaaaataaaacaaacaggaagaagtctgtcttcaga    29680
ttggatatgcaattatcctgtctttactgctgatttcaattataactcattggtgttaccagcccacgat    29750
agatgtccccctgcctatgtggtgtttaaatcaagtgttggcatcattcacacttgtttactgttattagc   29820
actgatggatgtaatcttcatgtcttcctctgaacactgcatgctgagaaagggggccttatttcctcgtg   29890
gatttctaggcaagagaatgtcaggccctcacctgcctatttccatctcactcagCAGAAAACACACT     29960
GGCTCATGGAAACTGCAAGCATCGTTGTCAGCTGCACCTGCAGGCACCATGGGGTTGCAAGTCAGCATCC   30030
CCTTTCAGAAATGAGGATGGAATTAGAGgtggaaagaaaattctccacagtcctctcacttctctggct    30100
tagacagggaggtttctgctatgttttcattgattatgctgtggggggaagggagggaggaatccccta   30170
agaagaacaatgtctcattggatattgttcctttgggggaaaaaaaaaaaggaaaggaaatattttcatt   30240
ttttcttacttttctaccctagaatctcaatgccaccttcaaacattttgaatctcacagggagaaggcg   30310
gccacatatttcaccccccaaatgctaggccatgtcttctcatgtcagaaatgccctattgtgcgtgtgtc   30380
cttgttgcaagccatcttagacttgttgtttcagggatagggaaaccattctgcaatccaaataaggttg    30450
catttcttgcaattcaaaataaaaggtgtgcatgcacacacgcatgctggtattattgtacagcttgc     30520
gtggtgcaaggctgaaggctaagggactaatggaggctgaaatttagccctagatacactctgcaagctg   30590
agtacctgtggggccgtattacctggctagaggtgtgcctatttctcatgcatccagtatcaggtactt    30660
tctgacttagagggtccctcaaccctctcctccttccctccacctatcgtacttagcatactgtatatt    30730
tgccttagtctgtttcatccaacttgatcacttggtagcctgcttttatccccactgtctaaatcagta   30800
tttggaatgtagtagggacacaaaaaaaaattagttgaataaaggaataaatgggtgaaatagtgaatgca   30870
tgaaaaaggaaaaaatgaatatttggctgctgtgtattcttgtattgttgttatatataattcttctgc    30940
ctgtctttcttcatacatacctcattattagtataaactaccagcattcgtgatatgcaggtcttgctt    31010
ttgcagagagccatgggtttctctaaaaggcatcttgcagcctcccgcccaggtgtctctgtgcagcta    31080
acctggttgctaatctctgcaagctcgtacttttctgcagcaggtcgttctgttctcattactcttgt    31150
aatccttctgtttccttctgaccagcttgagcttctgtatctagtgccttgacgttctctttcttcttg   31220
gtctttttaacattattatgtcagttataatgttttcagttgcttttagtattcagaaaattcttgaag    31290
ccttcttattgcccactggtattttgtcttcgccgcttgttgttgggtggatttagatatagcagagag    31360
agagagagagagagagagagagagagagagagggaaaatagagacagagatatgtaatccccccaaccaac   31430
cccgttatctgtgatttccattacccatggttaggttagtacagtcagtgatattttgagagagagaa    31500
agagacatcacattcacgtaacgttttattagagtatatattgttacagttgtatttttattttaattgtt   31570
gttaatctcttactgtgcctaatttataaaataaacgttatcatgggcatgcaggtataggaaaaaacat   31640
tgcatatatagagtttggtactgtccacacgttgaggcatccaatgggggtcttggaaagcatccctcac   31710
tgcccctggtaaggaggagctactccagttttgagaggagaaactaaacagatatgaaaaacatacaagt    31780
tgtaacctaataggaaaattttttaaagtgttattaaaaaccatatcttatatatctcatatattaaagga  31850
cttcacaatggactttaggaaattaagatggaagttgcaatagcaaaagtttagcaatgcgtattcttac   31920
atatgaaaatcaaaattaacctagcagtgttctgagcaacttcactttaagaagtaaaactagtgaaatg   31990
ataaaggtatatgggtgctgactgttacgtaattaggctgatataatttagcaaggatatcagaaatcat   32060
ataccaaaatgagctttattatattcaaattagtcacttcagaggcagtacactaattacaataaggta    32130
agactgctggaaacttctttatttctcctcacttttaaaacgtttcagagccccatagtaatttatttttaa  32200
tatcttgctgaggcaagtcttaatcctaaggaggcatttatatttggatacagccagggttctgttgag    32270
taaggtcagtgaccacattgtataacacaattttaattcaaagacaaggaacagctataaataaaggtga    32340
gcttgtttcaactaactctttttattttttttttattttttttattttttttattttttttgagacaga   32410
gtctcgctctgtcgcccaagctggagtgcagtggcatgatcacggctcactataacctccacctcacagg    32480
ttcaagcgattctcctgcctcaacctcccaagtagccagaacagccacgtgccaccacgcccagctg     32550
attttttgtattttttttagtagggacggagtttcaccatgttagccaggctggtctcgaactcttggctt   32620
caagtgttctgcccgccttggcctcccaaagtgctgggattacaggcgggagccaatgcgcccagcctca    32690
actaaaccttaaggcacattgaaaagaaatcaaaatgcattgagctaaatgccaggcatatgcctttcc    32760
aaatggacttgccatgaaggatgtcattcctgtgcagccaggtgttgtcttctatgtattttttagaatgc   32830
ccatcatatagtctcacctttaaagtctgtttagtggaatgttttctaacttttcccatgtacctcccat    32900
gtcattttttgccagttctgccttcccctaataaccaatgaaggtacttgcttcatgttaaattctaggta   32970
atctggtttctactgaattagaacattcccaccccgccaatgtctttgaataattaaaggttttataatgt   33040
```

FIGURE 8A-48

```
ggtttccatacaactaactgaatatttcatgtggctagataaataggtaaattgcagtacagtagcaatt      33110
ggtgtagacacttagagggtcctaataaattattgcacacgccaatgtgcaatcagaaagaataactgta      33180
gtgttaagcctcagacaatgctatagacctgaggatgggcctgtgatggacggatcaatggctcagttcc      33250
tattggagtttcacatctaggaataagtgaattcacgactattcatcagctgctgctactgtacggaagt      33320
gtgtccattgagaagttgcagaaggggctgggagattggataaggcttttgcagtaccctcctttttaa      33390
aaaagcagacagggtgtaactctattgcaggctggagtgcagcgttgtgaccatggctcaccgcagcctc      33460
caactcctgggctcaagtgatcctcctgcctcagcctcctgagtagctaggactacaactaggcaccacc      33530
ataccaagctaatttttttaaataaattcactgagacagagtcttactatgttgcccaggtgggtctcaa      33600
actcctggcctgaagcagtcctcccatctcagcctcccagagtgctgggaacaggcgtgagccacggt      33670
gcccagcctcaataccttttaaattaacaggaagtggaaaacagaaattctgcagcatgttttttctcatt      33740
agcatgaatcactctctggtgatgtgttcatggtttctaatggtattttcaagatggacaatataaagac      33810
aaccattagaaaccacaaataataggcccatatgaaacaatataatagatgcatgaggttaactggtcaa      33880
catttatgctgaacttagatttacactgattaaaaaaaataatccatttgaagtgtaacacacagaaacc      33950
aaagttctgtgtgttctgttatcttatattatcaatgctccatgcaatgtgaaagcttaaggcaagtgtt      34020
tctataaccaacacccatgtgaagaaatatagttccatcttcaaagcagtgcatgctcttttcccattc      34090
tatctcctatcctcctccgtgataaccattattccctttctactactcatttccatgcttttctttatat      34160
tttcccaatgataaaggcatccctgaatcacataattaaattttgcttgtttggagactctaaatgaatg      34230
caactttctattacttctggtgtgttttttcatgcataatactgttttataaatttcatatgtgttgc     34300
tgtgtatacatccattccactcattttaattgttgtatagtgttctaaagtctgaacataccacagtccc      34370
tatgtccattttattcctaatagatatggttattattttgagtttgaggttattataaattcgtgttatt      34440
aacattcttttcaggcaccctcctttctcacaagcattggttttctgagacatataccattatggaatt      34510
gctggttcaaatcttcaactgtatagtttatataaggatgaactgttttccagtacagaaatgcctgttt      34580
tcaccaggagtgtgcaatcttcaacatgtggcagtataaaagttctatttttattttctgatctagcgtg      34650
tgtacatggaaaaccattgtgtgttcactgtgtttactctgaggttgaacatttccatatatctcttgg      34720
ccattcatatgtcctgtttggtgaagcgtctgttttttgatctgttttctactgggttgtgtgtcttatt      34790
gctgtatttcgattagagtgcttcactgattatatatgttgcaaatatcttctgattttccttccatgtt      34860
tttaatgatttatttaaataagctaaagttcttaatgttagtttatagactttacaatattttctttcag      34930
attagtgctttggaattttttgtttaggatatcttttcctaccaagagatatgaagattttccttttattttt      35000
atctgaaaaagcttaatattttatctttcatattgaaaccacacaggaatatatttattgcattctgt      35070
aagaggtctagttttatttttccttagaatatcacaatacaatttatttttaaacagtttgatccatgtcac      35140
taaagttcaagtgatctctttgtctacctctgtgccaatcatcacattttttatcttcatgatttataat      35210
aatccgcaatttatatttttatactttgttttatttcttgccaatatgcattgcatccctgagaaaagtgt      35280
ttattttgcgatggttggtgcaatgtgctatatgtctaatatctcaaactgttgaagtatgttgttcaca      35350
tactctatatagttttccaggtggtagtttacatattcttttcagtaactaaaataggtctattaaatttt      35420
cccacgatgtttatggatgtttttaaaatcttttcgtatattttccaaaatttagtttcttgcatttttat      35490
atgcttatgaatttagtggatacagtctagaattttttattgcattgtggcaaattaaggttcttctcat      35560
tataaagtgatcctctgtaagtctgtggtgcttcatgccttaatgtctgtttagtttgacgttaacatta      35630
ccttgtttttgttagtaatccaattgtgtatagttccatctttttacttcaggccttttctgttgactca      35700
ggttttgagtcttttctacatagcgtctatttgggtctcataatctttgattttcaaccgcagatccact      35770
gatatttacttttattttttgatatatttgtgtttaagtcttctatcctaaattgtgctactaatatccca      35840
cttctacatcttgcttgaattgcttttttaaaaaatcattcaggccaggcacagtggctcacacctgtaat      35910
cctagcactttgggagaccaaggcaggaggatcactttagaatcctccaggagttcaagaccagcctgag      35980
gaaccatagcaagaccctcatctctatgaaacataaaaaaataaataaataaaaaaataaattagccag      36050
gtgtggtggtgtgcacctgtagtcctaggtactccagagataagagttgacaggagagtctgatccccatg      36120
agttcaaggctgcagtgacctatgatggcaccactgcactgcaacctggatgacagaacaagatcctgtc      36190
tcagaaaataaagaaataaaagacaaataacattactccatttccttcactcccacttctccctctacac      36260
tagatgttaaaagactgtactagtttagtaaataacccctagaaattacaacacagatccttaatataat      36330
cactaatttaattaatacattttccacttctctgaaaatacccagtagtcagtgtattttagctccatg      36400
tttatgacctaaactacttgctgttagtacccttcaatgtttttgtgttttttaggaatctttttcagata      36470
tgattgctatcttattatttcaatattaattrtgatttctgatgattacactattttatttatgtttc      36540
attactttttgtacctcctactttatctgtgattattgtcttaaaagaatctatcggtgatctaaaata      36610
tatttcagagctaacaagctgttggaaactctgtttgcatggctaaatgtgtctttatgacatcctctt      36680
cttgaacaatattctcattgaatttaattctgcaattacttctttcagccatctgagaaatcattctcct      36750
attctctggattccattattggtatggagaatttagctgtcagttaagtgttgctccttaaaaataat      36820
atattttctgcagatagtttgtctatatccccctgatacctttaagatagtttttctttgagtttctgcc      36890
gtttcactgtgataccattaggggtttattaatctgattggaattccttgatgaccttgaaatttgcaat      36960
cgtggtttcttccattctgaaaatagtcattacctcttcaaattttggtgctgtttctcttgttttttcact      37030
ctgtttgcacataatttagattttctccctctggctccttttttagtcttttttttttgtattttgtat      37100
taaatttttactttcaagcttcattctggattacttttctcaagacctataatctatttcattaattctc      37170
ttttctactgtatctaatgcatggttaaaccaatgcatcaaatctttatgtttgatatatattttcatta      37240
catttcaaggattaattttagtttcttcttatagtttccacattttcgaagttctcaatttttatttttc      37310
tggaatgcattcttcctagttattttaaagtctgcatttgtatttctatttttttcaatcacccttttg      37380
tttctttctcttttttgctttttggttcattgactaattctttcatgattctaagtattaattatgca      37450
tatattagatattctcatattgttttccttatttctaactctctatttttatattttttgtatatgacagc      37520
tccctgtgttgcccaggctggagaggttgtgctctgtgcccagtggcacaatcatagctcactgtagctt      37590
cgatctcttgggctcatgtgattctcctgcctcagcctcctgagtagctgggactacagtcacatgccac      37660
catgcctagctactattttatactttaaaattttttagagactaggtcttgctttgttgcccaggctgt      37730
tctctaattcctggcctcaagcaatccttctaactcagtctttgaatagttgggattacaggtgtggc      37800
cactgcacccggtttcccagcttttttcagatttccacgatactctctggatcgtttcttctcacctctt      37870
ctcaagtttgtccatttttctcttcagctttgtttaatctgccttcaggtggacccattcattttctcat      37940
tttgtttatttctctgatctagaagtttgatttgattttttattttttcatttttaatactttcttattcc      38010
ctgcagatgttttccaacttttttgttttcaagcttttttgaacattcttcaaaaaattggttatcatgtat      38080
atattttcatggcatcttaattcctttgggatttctgctggctcttgttggtgacttcttgtttcttcct      38150
```

FIGURE 8A-49

```
tcatgggcttggtaatcattgtgaattggccattgtatttgcaaatggattagtggcatctttctccaaa        38220
gcagataacccatgggtagcgaaattctaggttccttcatccatggggccatgctcttccctgaattgtt        38290
catagatgttatgaaggtagactgcaagcacttgcaagactgaatttagttttgttttcatgtttgccttg       38360
agggtgaaacccatgaaggtaggaaaatgttaaaggcaagtatattagattgggaccttcaggcgtgact        38430
agggtctgagagttgccccattacatggtgatgctgcaagaactcccacagtttcttccagattggaaca        38500
gtgcactagggcaaaggctgctttgtgtgctgggcatctagctggatcatcatttggtcgtcagtgtgtt       38570
tttgtttgtttctttgtttttttgtttgttttgtattgtgtttgtgagacagggtcttactgtgtcatccagg     38640
ctggagtgcagtggcacgaacagggttcactgcagcctcgaactcctgggctgaagacttcctcccacct       38710
caccctccccagtagctgggaccacgggtgtgtgccactacgcctggccactttttaaaaaatttttgt        38780
agagacaaggtttcaccatgttgcccaggctgtgataatcagtttgaagctgtaatcttaaatatgatt        38850
ttagcactaaaatgtttttaagagacttaaaaaaatcacacatattacaatccatttcaataagaaggt       38920
tggtttgaataatctactctgttactgctagatgtaggcttctgatttattctaatatattacagaaatg       38990
agtaggtggaacatgagtttataaagataatgcaaatattttattagcactgtattctcttaagagcagt       39060
tcagagttcaaagaattgtgactttatttcacaggcattaaaataaattaaatcagcaatctcattccta        39130
acaactcaaacttcaaagaaatttcagacagttaatcatccacctgacaccacagcctatgcaacttgggt     39200
ttaattaggatttatgttactggtagcattgtggttgaaaagatattttcattaacatttctctctgaag       39270
cactgagtcatactcttgtttattcgcaagttctttacacttttcaatcaatatttgagtgttccttgg        39340
gaaatgtatgtttggctattttggtgttttttgagagtgtttgatctttgaaaatgcatgattaaaagcca       39410
ttttagaaataaacatgagtgttttaaatacaaattactaaagccactgttttgtttcaaatttagggat       39480
ttaatttttttaatgaaaatgctcctgtttatatatgcatgaggttatgtaaggtcatcaacttaaagat       39550
tcatgatggatttagtgccagctgttgattagtatgtctgcaatcaatctacaacatagcaataacgcta     39620
gctaccttggagagttactgggagaaataaataagacaataaatgtaattggcctagcaaacttcttt       39690
gtatactataattattcagtaaataataaaaccttgtgattatttatctatcaatcagtcttagagcagtga    39760
atttacctttaaaatctagacacattaggaaagaataatggtagatttaagacaaaattaaaatttctt       39830
ggtgtactcaaaaatatatattttctgttaatgcaaattaggcttttatatttattatttttaatatttg       39900
actctggaatgttttcaaaatttagttgagtagatcttaatgcaagtctacttttaaaaaatctcattat      39970
ctagtaggctttactagtaattaatttgaatttggtagacatgaaacaccaccaatttcttctgtacacaatc    40040
ataaatcctgtatactatgtatactgtgtatgcctgtatcttggtgaagtgggaattaaacttttatcaaa      40110
tttccattgaaaaactgaagagcaaactaagatgtaatcagaatgttaatataattgtagaaatggaaa        40180
agtttcagaatgtttagatttctcaaggaaatctcaaagcatgacacttttcattggtctgtcatggata       40250
attaggtcttttgctatttttatttatttatttccaatccgtcacaaacgtactttggttgatgcatata     40320
tcaactatagagtagtaaatctgacaaagtcatgcactgaaaactatactctgtcactgagggacactg        40390
atgaaggcttaagcaactgggagacagactgtgttcacaaacacaaccacccctcctgagaagatacaatat     40460
tgttaagatatttattttgtacaaattaatctacagactcttgcaatcccaaataaaataacagtagac      40530
ttttagaaaatacataaattaacaagataaatttaaaatttaatgaaaatacaaaagatctacaataac       40600
caaaacattttgtagcagtagaacatacttggagggctcctgctacctgagctcaagacttagtataga       40670
gctatattaattgaaacagcgtattattgacataaagatgtaacacctgatcaatatcatagactagaga       40740
caccacatagaactgtacatatatggacaatgaattttccaaggagattcaaaggtaattctatgcagga     40810
atgattttttttttcaagaaatggtgttggaaacattaagtatccatatacaaaagaaaagaaaaagtaaa     40880
caaaaagctttgatctataactcacaatttgtacaaaaaacaactgaaagtgagtcaaatacctagatg       40950
taaagcttaaaattgtaaaacttccaggagaaaaaaaaaaaagaaaaatttgtgactttagattttg         41020
gcaaatatttcttacttaaaacaagaagcttgattttaaaggaaccaattaatacattggactacatca      41090
aaacttaaaaaaatgcttatgctcacatgaaagacattgctcaaggaatgtaaagagaattcacaaactgg     41160
gaggtaagataggcaaattaaatatcggatgaaggtattgtaccagtataaatgtatgcatacatacata      41230
tatatgatgcagtttcctataaatatatagtatatatggtattagacatatatgtatagacacgtactgg     41300
tacaattatatactatatatacaatattcatatatagtatatatgatacagtattgtatactatatataa      41370
aatatatcatatatttaccatacagtatatacacatatgtatatactatgtatactgagtatcactatt       41440
actaaaaattacagaatgtgaactatgaaaatgtaaaagcctatttaaataaaataaatatttaaaatac      41510
tgtgttttttatatatatagcacatgtactatactaaattgtatacagtatactatatatagtatactgt       41580
atcatatatattgtcaatatagtatataatttaccccctgtgtgtgtatagatctgtgtatatgtgtgtat      41650
atatacacatatatgtatgtgtgtatatatacacatatatgtatgtgtgtatatatacacatatat          41720
atgtatgtgtgtatatatacacacatatatattctaaaaggagtatttaaaagaaaccaccccctataac     41790
aattggacagaaaattgaacaggcagttcacctaggaaaacatacatatgaccaatagccccaatgaaat      41860
gtgctcagcatcattagtcattggataaatgcacaaatgaaaccacagtgaaataccactacacatctga     41930
gaatggctgaagccacaagactcgctatgccagggcttggtgaggatttggaggagctagagtccacccc      42000
aagctgctggtggggaagtgatatgaaaccaggacttttgagaagagtttggcaatttttttgttgttaa      42070
acctacaagtaccatgtggttcagccatttaactcctaggtatttacacaagaaaaagaggagcatatgt      42140
ccataccaagaccaagaacctgaatgtattcataggctggaatgcttctgagcagtaaaaatgaatgaac      42210
tgttggtgcatgctacaacctgcatgaatattaaaatgattatgccaagcctaagaggccaagcaatgaa     42280
gagaccgtaattctgttacttcgcttttaatattttgcaagctgtaattcataatgcctgtctgtaagca     42350
gataactgtttgcctgagatgaggaggaggagcaagagatatagattataaagggatatgggtaaacttt     42420
gggtgtgatatatatatgtacatgtatatatatgtgtgtgtatgtgtataaaatacacatata            42490
tgtatattttaaacagagtctcactctatcacccagggtgaagtgcagtggcacaacctcggctcactac     42560
aacctccacctcctgggttcaagcagttctcctgcctcagcctcccagtagctgggactacaggtgcat      42630
gccaccacgccctgctatgtgtgattgatattctgtcaccttgactgtggtgatggcttcataactgta     42700
tacataagtcaacatttattatactgtatactttatgtacagtttatactttacaactataacttcaga      42770
aaccccactacccctattttaaaaaagttaataattactctcagtcctgtgagacctcactgttttccttat    42840
gctcattttttcccttttaacaacaatggggaactagtattttatcagataaaaataatgtttgataggatt    42910
ttgtgcaaagtctgtttgcctactaattctgccttatggcatctcagacatgtaaattagacaagagcc      42980
ttcagtatgtctgatctgttgtcacgttattttccactagtttgtgtgatttagattattttttaaagagc     43050
tgataaaggaaggaaggaagagagagatagaagaaagaaaagagagaagaaagagaaagaaagagaag       43120
gaagggaaagaaagaaagaaagaaagaaagaaagaaagaaagaaagaaagaaagaaagaaagaaagaaag      43190
aaagaaaaaagagacgcctgtcttttttaattccagttggaagcagctttagttataaaatttccactct    43260
```

FIGURE 8A-50

```
ctagaatattcttggggaaaaaatgaagtgtcaattaaattgattttttttaacttgcatcctatgtctct    43330
gaacatgattcttttttcaatcaggcatgtagttattgagacccatttatgagctgtgcatacatcccat    43400
ccaattccatccaattccgtccaatcctgtccacagacatgttgaaagcatgagcttcctgcaagagcaa    43470
tgcaccagccgttttcctagagatgggtcttcaaagagagggttctttctcggagcacctgctcagggaa    43540
caagactgactttaaaccagtgttagcaatatgcatggtacactgaaccatctgctggaggacctccttg    43610
tgtccaacacagtccttctcttgaatgtcatggaaaagactgagggttgaagcaaatcattttatgcagt    43680
gaggagaagaccgtgctcatctttcagtttttgagccacatctaatttatagtcaggtttggtagc      43750
ctcagcactactgatatttgctgcataaatctatgctttgttgggttgtcctgtgcattttaaggtatt    43820
gaatagcatcccagttcacacccaccagataccagtatataaatatataccgttttgccaattaaaat    43890
gaataagaaaaaatcattgttacagattaataataataataataattaataataagtggctggacacag    43960
tggctcatgcctgtaatcctggcatttgggaaggccaaggcaggaggatcccatgagcctgggaatttga    44030
ggccagtctgggtaacatagtgagacccatctctaaaaaaaaaatgaaaaattagccaggcatggtgat    44100
atgtgcctgtagtccaagctactcaggagactgaggcaataggatcacttgagcccaggtgtttgaggct    44170
ccagtgagctagctattgatggttccactgcactccagcctaggcgacagagcaagacctggtctctaaa    44240
aaataaaaataagtaaataagctaaatgctcttgaactgaaaaaagaatgtattctatgagagatacct    44310
gataatcacctactttgaccatgttttatccttcaaggatttcaaactgttacaacaaacttctaaacg    44380
tgtatctcttagttcagcttccttacatgaatttaatgctccagtatgtgagaccaattattgatttaa    44450
aaaaggggtagatctgtttaaaattcctttaccaatattcctcatgctcatgagaaagatatgaggcagt    44520
gctgttgactgcatttgtatttagttaataccacgagcaagtgggaaaaattcagaagtgacactgagtt    44590
ggtcatctctcaattatcatcatgagaagtacgcacaatgtgaacattctgccatagggcttgtctctgt    44660
aaactgctggtcaaggggcatggacagattctactatttttaaaaacatctttctgaacagataacggag    44730
gctaattgtagtgtaaacacactgatgtacaaatctcgaaaaacataaaataaagtgtgttgagattgg    44800
aggtgctctgttcaactttcgagggatagaaaatatgcctatcagctgtaaaagcggtgcatttatttc    44870
atttttttgagaccaacactagagcagaaagacacattaacaaaagggtaagagtcttcagagcagattac    44940
tcccacttgaaaaatgagttaagtcatttcacagcgggagagagggatatttgcagcaagaagtttcatt    45010
agtcactgaatgaggtttctctgacatatattttcacagaatgagaagcatgatctttagaagcaagagc    45080
cataaccttttctatattttttcttctgttattcattttgctggaagattcccttccctagcctctgaa    45150
atttcagccttctagtctgatttggtgacctttgttcactaggaagaacatagtccgtttctcttttgcca    45220
aaaggtagttgcatgcatttgcaatttaaacaaggaacatccaaaaaaattagaatgtgtgttgttgaa    45290
aatattgtgattattaaagtcagagaagatagctaaaacagaagatgcccatactttgaaatcagatgat    45360
tattaatagatgctgcttgtgttgactggagtttaactgccagtcctttcttttgccaagatatttcc    45430
caaaagaaacatttcagttgtaggctcaataaggagactgcttgtgaattggtggcaaaagg            45500
aaaaggtggggaaggtaggagaagaaaagagagatggagcctttcaggtaggagactactttttcttcctt    45570
tggtgtctcatcttaatatttaaaaattaaattgaagactcagctaaggtatagaaaatatcaggcttt    45640
ttctttttgacatataaccaacattatctcttgtcaagcaattttatttttttatttattttttaattt    45710
tctaataagactaggtttattcagtaccctagtaaaagtttttattataagtatccaacagtataaaag    45780
tacaaaacagacctgtagatttctaatatattaaatcaaagtgctttattttttaaaactgctttttttttt    45850
ttttttttgaaacggagtcttgctttgtcgcccaggctggagtgcagtggcgccatctcagctcactgcaa    45920
cctccatctcccgggttcaagcaattctcctgcctcagcctcctgagtagctgggattacaggcacccac    45990
cactatgcctggctaatttttttgtatttttagtagagatgaggtttcaccaagttggccagcctgctct    46060
caaactcctaaactcaagtgatccaccacctctgcctcccaaagtgctaggattacaggtacatgtcac    46130
cacgcccagctaattttgtactttttagtagagacagggtttttaccatgttggccaggttggtctacatg    46200
atgacttcctaaacaagtgcataacttcgattctacaaaagatgacagaattcattagtactactcgttt    46270
gtcctcagttatactttctgcagtttcagttatctacggtcaaccatggtctgcagaaaattccagaaat    46340
aaacaatgcatcagttttacattgcccttggttgtgagtagcatgatgaagtctccagcagtcctgctcc    46410
ctcccaatccatcctgcccaagaggtgaatcctccctctgtctggcattttcatgctgtagagactgcct    46480
gacccttagtcacttagtagtctgctcagtgaccagatcatctgctcatggtactgcagtgtttgttctca    46550
agtaacccttatttcagttaacaatggcccccaaagtgcaagagtagtgatgctggcatagtgttataatt    46620
cttctattgtattattagctattattgttaatttcctgtgactaattgataaattaagctttatcatagg    46690
catctatgtataagaaaatgcacagcacatataaggttcagtactatctgtgtttcaggtaaccactac    46760
aggtcttggtacgtgtccccgtgggtaacggaggactcctattgtctgtgttttatttgaagggattttt    46830
gattcatttgtgattcgtttcacgccctcttccttttctcctctgcgcaaatttgagttggtcatgtggt    46900
acttaatctttaaatgcttgatccattctattctgcagaagaatgttaaattttttcattatgtcagtca    46970
atatgcttttggaaaaagggacactcctgtttgtgtttcctcttaaattcatggtttagagttttctcc    47040
tcttcctttcgcttgagcctcccaactgcagtgtctcctcagtcctctaactccatgactgtggataa    47110
actccatcttgttttcttcaatgtgctatttctcaagtttacatctacaaatgtgctgcaaatatctgg    47180
tactgaatgatgtttcatttcagtgaagcgtttgtttgttttgaaagttaattgtgcatgtggt      47250
ttaaaaaatccaatataacaaaggcatacagggacaccatttgaccatgccattccccaccccttcatt    47320
cagttgtttcagcgaccacctttctttgttgtggcttgagaatccttccagagacgtgactaaacagcca    47390
tggaaatgccagtgcaacagagcattctttacatcttgctttttccacttaataacataacttgaggtt    47460
gtcctatttgacacatagacatccacctcattcttcaggaagcctctgtcacaggcacatatatggacc    47530
taccataattcattgattggactgccatgtggacagaagttgtttccaaatacttgctaccataaa      47600
ccctagtgcagtgaaacttccttcacacacctttttttttcttttttgagagggagtctagctatgtcac    47670
ccaggctggagtgcagtggcacgatctcggctcactgcaagctccgcctcccggttcacgccattccc    47740
tgcctcagcctcccgagtagctgggactacaggtgccgccaccacacccggctaatttttttgtatttt    47810
tagtagagacggggtttcgccgtggtagccaggatggtctccatctcctgaccttgtgatctgcctgcct    47880
tggcctcccaaagtgctgggattacaggcgtgagccctcacacacctttgagtgggggtaggattccat    47950
atctattttaaatgtatatagatgttattgagttttagaggactaaacaattttagcttccaagcataacc    48020
tataaatgcatcttggccactttcttgccaacagagtgtgttataaagcatgtcatttttgtctgtctca    48090
ggtcagtgaaactcctgtaaaggaccagatagtaaatgtgagccacatggtttctgtcctgactactcaa    48160
atctgcccttgcagtgtgagagcagcaatagatgatttgtccatgagtggtgtggctctcttccaataaa    48230
tctgtatttacaaaaggaggtcctggccaggtttgcttcctggatcatagtttgctgaccctggtctat    48300
ctaataacaacaataataatctttagtttgtttcttttgtatgagctaggctgttcatctgtttaaaaat    48370
```

```
ctacttaggtatttttttcctgttaattacatccgttgctcattttgcataatgcagtttaactttctct        48440
tgttggtttattaaaagcaatctatatatttgaaacttaattacttttatatattctgaaaaataattga        48510
tctgttagctgttgcaacagttggctttctgataaatttctatttgacatagaaccaagtaaaaattatg        48580
ttaccttgggttgtaacagttactcttaaaaacatttagatctgcaaggcacagtgtctcatgcctgtaa        48650
tcccagcactcttgaagctcctggcttcaagagacatcccgccccaccccgccccgcccccaccctt           48720
gtcttcccaaagtgttgggattatagttgtaaaccagcaggcctgaccttgtgtagacatggtaattgac        48790
aagaatcttgtagtcacattttcatagactatgcagtagatgcaatagactaacttctgtatgatcttt        48860
ttcattttgtattaattataatcatttgccaagtttgcttcattcatttgtttagtaaaagagtatgtgt       48930
aaggaatttggtaggcaattttagaacttttagtgacaactttgtttttgattgttcttagtgaaaga         49000
aggattacaataagaacttagccacaaaatacaagtttccatgagtcactgcaaaataacagggatagtt       49070
tggaaaggcaaggagtaaccagaagctttggggcatagttttccttagttaaatcagtataataaatggg       49140
gtacacattgcaaattatttattcatagtttggtagtttgcattggtatgtcttaaacctgaatacttta      49210
gagtgaatgaagtaaataggatgagatgatggggaatgcacacacacccacacacatgcacacacaaaca       49280
cacatgcatgcatgcatacatacatgcacacacacatatacatatgtgtgtgtgcctgtgtgtgcacatg      49350
tgtgtgtatgtatgttacgtttacattatttctgcatattaaacacttccccctttcgttagatattctt     49420
tattgagaaaatgcactacactagattaccattacttaaaagttgctctcgcagcacaaatcaattcatt      49490
atctttaaggataagcccatgtctggaggtagggaaatcattttttaaaaattaaagtttctgtcttgaa      49560
atattgtcatccttcactttttctatgcactaggatgctctttgctttcaggaaaacacgttatgactca      49630
tttaatactgttgtccctcttatccagaacagaacataccgtggttgcctaacaggaaggctgcatataa      49700
aacccagttttgtctagtatcatttttcccaagtccattatgtgtgttattgtgcagtgcatgtccaaat     49770
gaggatttgagcagtagagaagaaattcattaaagaaatgtgtcatctccttgcaaaaaggaaagtattg     49840
ttgaggaaattgttactgataagacaaaagtggtgaatgaacatctaccattttgaaggcatttctctgaa    49910
gtgaaaattaccttgaattgtcttgggatcagttgacttgttgatccttctattaggagctgtttcaaact   49980
cagagaagggtgatgattcacactgatgactgaaggtttcttggagctggtgtgaataagaagggaaaa      50050
gtattgcaaatgcatcattgtggctttcactgagactcagtggacagaattcatcatgatcttcctgggc    50120
tccagaaacacaggcttgaaatttagtagccagtctgccaagcatggagttaggcacagatgggatctga   50190
gttagagaactctcctgggactggtacccagggagggtaatgtaggggtgaaatgtcattgttcaacatgc   50260
ttattattcacctgaacatgggtgacattccttcctgagaaactctggtctgacaaatgggttcttaca     50330
attatttctgaaaatagaaaatgtatttccaataattattagttatatctatttattatttctagtcata    50400
ttattcctaataattgagctctatggctattgggtgaggttcctcagggaacagcggattctctgttact    50470
gaaggagttaaacagtatctataccgagagtagtcaagacatgcagagatgatttccatattataagag    50540
aagttggattgaattaagctgtgattccctgccattctgagattttaaaagtccaggccttaatgtac     50610
caattccctgtcatcattagtctaattattggcaactcattgaattatacagtatagtatcagttgatg    50680
aatatagtatcaattgattggtacaacactgtatcaggttgaatttaactgagttaaggtatggccctac   50750
cttctaagagcttaccagttgacaataaaagcacatgggtaggcaagagacacccacattattagatata   50820
actatgttattcatgttacctaaagttggagagtaagaagaatgaatttcttgaggtagggatgaaagta   50890
tatcccattccaacagtttagatccagagaagaaaaatgtttcagagaggagatatgatttttaaaaat    50960
tgcttcagagagaaaaattcagattggtaatggcagcctagaaagatgctaaatgaggaattctaagtcaa  51030
aggcctgcagaaagctaggaatgaacatgtcactggttctcatggaaaatgcttagagtcctgcacgga    51100
ataaattccttttttttttcttttctttttattattatactttaagttctagggtacatgtgcacaacgtg  51170
caggtttgttacatatgtatacatgtgccatgttggtgtgctgcacccattaactcgtcatttacattag   51240
gttatctccttttttttaaatcattattactattgtattttatttttattatactttttatgt          51310
tttagggtacatgtgcacaatgtgcaggttagttacatatgtatacatgtgccattttggtgtgctgcac  51380
ccagtaactcgtcaattaacattaggtatatctccaaatgctatccctcccccctcccccaccccacaa   51450
caggccccggtgtgtgatgttcccattcctgtgtccatgtgttctcactgttcaattcccacctatgagt  51520
gagaacatgcggtgttggttgttttttccttgtgatagtttgctgagaatgatggtttccagcttcatcc  51590
atgtccctacaaaggacacgaactcatcattttatggctgcatagtattccatggtgtatatgtgccac   51660
attttcttaatccagtctatcattgttggacatttgggttggttccaagtctttgctattacgaatagtg  51730
acgcaataaacatacgtgtgcatgtgtctttatagcagcatgatttataatccttgggtatatgatcag   51800
tagtgggatggctgggtcaaatggtatttctagttctagatccctgagaaatcgccacactgacttccac  51870
aatggttgaactagtttacagtcccgccaacagtgtaaaagcattcctatttctccacatcctctccagc  51940
accgttgtttcctgactttttaatgattgccattctaactggtgtgacatgtatctccattgtggttttt  52010
gatttgcatttctctggtggccagtgatgatgagcatttttttcatgtgtcttttggctgcataaatgtct  52080
tcttttgagaagtgtctgttcatatccttttgcccacttttttgatggggttgtttttgttttttcttggaaa 52150
tttgttggagttaattgtagattctggatgttagccctttgtcagatgagtagattgcaaaaatttctc    52220
ccattttgtaggttgcctgttcactctgatggtagttttttcgtgcagaagctctttagtttaatt       52290
agatcccatttgtcaatttttggcttttgttgccattgcttttggtgttttagacatgaagtccttgccca  52360
tgcctatgtcctgaatggtattgcctaggttttcttctagggttttttatggttttaggtctaacatttaa  52430
gtctttaatccatttttgaattaattttttgtgtaaggtgtaaggaagttgagactggtagaagactaagct 52500
tcttccagactttaatcattgttatctggaaaggaattgaaaatagtttttttctgaatcattgtaatca   52570
tgtgaaatcactaaatgtcagtgttgaattgaccaaggaccaagctaattatgaagaaataggtggg      52640
ggagacattgaacacagcaatccacaggagtttgagtaagtctggactgttgaactggtgaaagtcctcc   52710
ctgcaacagctccatcggggcaattctgttaagtcaagactcaagcactggacggtgaatggtccagaaa  52780
aactatgtcattaaaaatgcacatttgtttaaaataactaactgctctttcgtggatgattggtactaag   52850
attttataaactgtttagggaccaccatgattcctcacacacattaattaattcatgagagttgattttc   52920
ttttcaaacacattgatacattattagtagatagcaccccaacacacacacacacacacacacacaca    52990
cacacacacacacacacacagagagagagagagagaggggtacttacaatcaaagacagccatact      53060
agatccaattggtagcaacaaagtgagaaaagtaccagaacacacaggcaaattgaaaatacacaaagcc   53130
acatccacagcatgccctttaatggacgaagtgggaagaaggttccatttccactctgctcatttctt    53200
ccccaccacccattaagagtgtcaattctcattcacattccttagagaagaacgaaccatcgaaaagg    53270
gagctgagagttgtaataaaaatattgcattacgatttctccagtttcctttcagtatgaagtatttgt   53340
tacttcattgaaaaaagtagaagtattgatcagccgcttagcttgtggcttctgctctcaaggagtcagc  53410
acatagtctgatgtggaggaaaatctataaatggatttctgcaatctgcaggtaagcatgggatgaaatg  53480
```

FIGURE 8A-52

```
ttccttgacatccaacccaggttagaaatcagttttcaagactctaaatttgaggacccctaggagctca      53550
aatgataaagagaagaaggtttatagtccatgatgggggagggactgcacactacctgcagggtgagcag      53620
aaaggatgcagggggcttggtatcacaggaccagcattgtaaatattacaggaagtaacctttcctgtctg      53690
tccttcatgtgcttttctttgtgcatattcttgaggcttaaaggaaagggagccagtctgtgtccatact      53760
tctctcccgtgcacatcatcccggcatggcactgctgatgcaaattaaaaaaataaccttTgactagaag      53830
cattttcccagctaccagtttccttctcccagtgcaagacaatgtgacagcaaaggttcatgcacagaa      53900
gcagaaaggtagtggaatgactcagcttctaactaaattccttccaccttccttagctttgtggtctcag      53970
gattttataagaggtctctcatgtgctgctacagaaccagcaggaaaaatcagacagggccaagacagag      54040
agaaaagagacacctttctcctatattgcccctacctagggctcctatccaaagcatgttctagttccta      54110
gatggttgattccaataaaataacataaaaatgtgcaataaaaatttaaagggagttgcgctgac      54180
catcatttttgaaatatttaaaaatgagtcctcagtaaattttggtgtgaacattagtatttgtcatgg      54250
atagaggcacaagaaaggagtaaatgtgagacctacattgcatccaatgcctgcatcagtagaatctaat      54320
ctcttcccccatgataaaatggcctccattctgtcaactacaggctttgctagctttttctcagacaaca      54390
gaccaaatttatccccagcctgataaggatcttattgcatttgctcccacccccacctactgtatttagg      54460
gtaatggtgaaaaatgtacattgatgctgaattttatagaaatagtagaaatggaaatgatcttacagag      54530
ttgtcatctactatctggtgtaggtttggttacaaagctgtatttcctcttccaagttttaagtaatcaa      54600
gtttcaaaacaatctttcctgacatccagtttgtgttaaagccaatttcccaaatgattttcatttgcat      54670
tctgaaatgcagtgaagccttgacattttacaaaatgacctatcttctactcaagtcaatgaaactaca      54740
gtaaacattttatgtgtagttgcaatgcttgtatctccctcaagattaaacacagaaaagcatctttggg      54810
gaggatatttaaatacgatattaaagcatataacatgtgtctgtattttttcagttttaagtatacttac      54880
taataataacaggcaaagtggtacgagtaaaacactactttttcattgttcagtttacagtagtcattga      54950
ctattctacatatgcgcttagcataatatttacagactatgaatacaaatcacactctgtgaattctca      55020
tgtcctgtgagacacaggaacagaagagctttgtaaaaaaacagcaaagtacaacttgaaaagttaagcc      55090
atatgagtaagaaatcaaagtgatgaatttactaagtgtttattaatatttaagctaagtttacacatga      55160
ctcaacatcatattcatactcatagtctgttactgtactttgccaaactgtctgtactattttgtgagag      55230
gatattatctttaatattgctctcactgcaatgaagcataaataaagtatatgtcatgttctaccttttc      55300
aggagctccaatgaacacatgctatggttttaatgactgtaaagaaaatttcaaagccatatcttatct      55370
gtttctatggagaagttgatcaatgatcaataccatttgcaaggaccccgatgtgtgacttgtttctctt      55440
tatactgtgacatgtttccctgaaggtggaacgtcaatgagacattcattttctactaaatgaaaatgat      55510
gttaaagttgcagtctagtgataaagttaccaagatctgcttcttggattttttatgggtttgggcaac      55580
acataaagaaactttcctctcattcaagttgaacatatccaaccacttatatatatgttgcccagtgagg      55650
tcagtgttacatgaagttgtagaacattacttgaaatgaggttttctcatttaataaaagtgtcacct      55720
tgtgtcagtggcttagctagttccagcttctattttatctcttatccaatgagaatatgcctatcacata      55790
aggagtgtggctgggaagaatggtggtctgtcctatctcctgggtctctggtttcagaacctgcacag      55860
cggacagttccaaacactgcattccaccatcatttcatcagcattcctcttggaataaatgtgtcttgac      55930
agtctctcttagaagtgctttctctgaagctactgaggaccatgccatgtgtaggcataactgaagcgtg      56000
cacattctatagagtgcctcgaagatgtgcacattctatagagtgcctccaaggttttcaagaagaatgg      56070
agcccaacttggccacattggttacacacttgtgcatgtgccatttattgactatcccaccttccaagta      56140
atttacctgcacccgacttcttgtctcatgtggggcctttagagtaactccaaataagaccaggtggatg      56210
tgcagatgaaacgtttgatgcttgcatgtgcttgcctgattatgactgttaatcaccaggtgtgtcaaac      56280
tactctagatgctcattgtgtgtgtatgacaggttttggtgctcttctgcttttgataagccattcaat      56350
ttaataggtgttctctgaatgcccagcttttctttaaacttagcatgtatattcactaccccacgatcc      56420
acctaagacagttgcgtatccatttctttatgcctgttccgtgttctatgtatattagatgatttcatata      56490
gataaggagggaaagctcatatttttatacattttaactattatgatgaaaacctatctagaagaggttc      56560
tcttctttttgaagttgcatagcattagtaaagctataggagctatctcttgtatctgactagaaacgat      56630
acacatttaagataaaaagcatgggccaggtggtggcatatgcctgtaatcccagtacttttggaggcca      56700
aggcaggaggatcatttgaggccaggagttcaagactagcttggaccacatagcaagccctccctcccca      56770
ccctgtctctacaaaaagtgaaaaaattagccagtcatggtggcatgtgcctatagtcacagctgctcga      56840
gaggctaagttgggaggattgctggagtccaggagttcaaagatacgctgagctatgatcatgcccactgc      56910
agttcagcctgggtgacagagtgagaccatgtttcagaaaacaagtgagtaaaataaaataaaaagcaat      56980
aacaagattgcattatgctttgagggcattaattttcaaatcttaacttacttgcatttttttcctgtca      57050
ttcttctgtgtcggctagttcttattttagttgtaatcttttttagaatacttatgaatagaataaat      57120
accactgtattcacatagtatatttactattattttttgtcttccttgcattgtattttaattatctatgtc      57190
agacactttcctcagtcaaatgtactactagccatctaaatggagaatttatcttaggaggagaattctt      57260
ctcatttattttttgcatacccagcaaattattcgggagtgagtgcactgtttcatcctgttgatagtctt      57330
ccctgaacatttataacccacccctgactggctccagtctttacaccttcctcaagacctaacttaaata      57400
cactgaactgcctgaagtcgtctttgaattttacatcctttctcttaactctcatacactttgcattgtt      57470
ttcccatacaggggcatcaagaaatagaccatattataatgaatgtacaataaagtactaagagtaataa      57540
aagtaaatatattccgaagcaggaaagagcaaatgcttgggtttttTatagaaggagagaaacgataatt      57610
tgagaatgtttcatgaaactcttgcatttgagcagaactttacaaattaggcttaggcttcaatagtta      57680
aaaattagtgaagagaacatctctgcaaagttgaatgttctggtctcctttctgtttgtttagtgagcag      57750
aattgataatcgacatgcaagtgcctttTaaacttttccaaggaccagtcattggggaattagtgtggtt      57820
cctctgaacctttctagtaatcccaggatttgagtattaagaacagttagttgtgttagcctTaagatga      57890
aattctccatccttgttgttttgaagatgttacttagagggaaggagatgttttggtctgttcgggctgc      57960
taatacatcttttcttctcaaattttactttaagcagtcaggaggaaccaagccattccttcaacactt      58030
ttcttagaaatagcttcagctaaatctactttTatcactcacacgatcgccttccacaaattactaaaa      58100
catgaacacagttcagccaagttctttgccactttgtagcaaagatcacctttcttTcattgtgcaatgg      58170
catatttctcatttgcctctgacagctcataaaaatggagcttcctgtccatatttctagtgtcattctg      58240
ttcaaaattgcatagattttccctaagatgattgaggctttctgtacagctcttctcttttttttctga      58310
gccctcccctcactagaatcaccttcaaaggtctattcatggcaacgtaggctgtgtctagcatacactt      58380
caaaactttTctggcttctacttattacccagttccagagctgcttctgcatttttaggtatttgttatc      58450
ttaacaccacactctcagtaccaatttctgtcttagtccactcagactgctataacaaaataccatagtc      58520
tgggggtggggtgggggggggtaataaacaacagacatttattTctcacagttctggaggctggaagcc      58590
```

| | |
|---|---|
| caagatcaaggcagcagaagattcagtctctgttgacaacccacttcctggtccacagacagtgacttct | 58660 |
| ccctgtgtcctcacatggaaaagggtgagggagctctttgagatcttttcttgaaggacactaacctca | 58730 |
| ttcacgagtactccatcctcatgatctaacaacctcttaaagatgccacctcctaataccatctcctggg | 58800 |
| ggaagggagtttaggatttcaaggttgaattttgggagaatgccaacattcagcccataaaaggagatag | 58870 |
| tataggaaaactacagaaatcaataaactcttctactgttttgattaaaatatagcaagtgcattttgg | 58940 |
| tgtacatattttacttttatcttgttattattcatctagaaaacaaacgtacatagtgatagttaattct | 59010 |
| tccatgactttttgcaaaagtgttggtatgcattggctataagtctcctctctgacttcataagacctt | 59080 |
| ggaaagctgccaaatatctcagaacttgttgtcttgagtcttaaagtgactaaaatgaccttagctctac | 59150 |
| ctgccttataggatgctctgcccaatgatgcatgcagtatgcatgttcttaacagagtatgttttgaga | 59220 |
| ctgcaggtttaggcgttattagaatccatttgactccatagccctttttatggaaacatacatacatact | 59290 |
| taatgtcaaatagtttatatcttttactagctaatatggataagtactgtctcttcccatttgactgtg | 59360 |
| tgtaactgccttctcttagaactcaacacaaaatgagctttatgattcacatttacagtaacatggagac | 59430 |
| agaaccacctcattcaaaacaggaaaaagcaggtataagatgccatgaagggaaatgagactgaatgtgt | 59500 |
| tcaatttttcttgtttggcttatcacatatcgtagagagatgtcctcttacatgcagtagaaataagaa | 59570 |
| catccttgaaaactcggtttgagcagttcaaaatcatatattttttaatgttgtatgagtttcaggtgat | 59640 |
| aaatcctcttcaggataccctcagggggttcgcaaaaatgtaaaaatatgtttaaagtttgaaatgactcac | 59710 |
| atttttagtatccacggcaaagaactgcttttccaaccttaataggatttcaaattgacattgacatttt | 59780 |
| tagtaaatcagaattagcttttttcttttaagctcctgtgtcttatgtaaatggctgtgctgactttat | 59850 |
| ggaattgaatattccagaaaatgtcatggaacctaatataaaacaagttaacattctcattttagatct | 59920 |
| taaagggatatggtgttaaaatatagctttgatacccatccaacctgtgcaaggttttctgtgtatatg | 59990 |
| cgaatttcaaatttgagaacttagcatgtcgatgaaggcaaatctatatacctgttgaaaacaaaattga | 60060 |
| aattctgaaggaattattgtaatttacttaaataagaactgtaagaagtcagactgttaatggagtgtca | 60130 |
| atagatttcttctgagagcttcaaaatctttttcactgcctttattacaagtctaccaaaatatctgttag | 60200 |
| attctgaaagccaatctctcattacaaaaagcattattcacaatttttaacttatttccacaatgaacatt | 60270 |
| ctacagaattattgtatctttgtttaaagataaaaaattctccctcgggaggctgaggcaggagaatggc | 60340 |
| gtgaacccgggaaggcggaagcttgcagtgagccgagatcgcactgcactccagcctgggcgacagag | 60410 |
| ggagactccgtctcaaataaataaataaataaataaaataaaataaagtaaataaataagtaaatgaat | 60480 |
| aaataaattctcccccccgaggtctgaaatttattattaatgtgaatatttttaagcattttttagaagaaaa | 60550 |
| taattttgtaaaaaatattgtaagttatggaaaatatggtggtgaagtataacattcacgaacttgctag | 60620 |
| aaccttgccctaaaaatgaactaattattggatcatatggcaaactgattaagaagaataaggaactact | 60690 |
| ttatatcatgaaaaaatacatgactatccacctgccttcctaaaacttcttcctctcatgtgccgctatt | 60760 |
| ttacttagagttttctttcgggttaaggaacaatatctttagaaggctattcattaaagtactaattaga | 60830 |
| aaaggtagttaattaagcttgtcacacacaatttatatattttcttatgatgtgtaagagaaaacagcat | 60900 |
| aaaaagataaattatttatttcagtcaaaatagggcactttttttgctttcctgcagctcattatacc | 60970 |
| taaattccttgtgaaagtatttaagtaagtcttgaaatattgcttttaaaatatgtttactctttaa | 61040 |
| agttttaaaaataaggaaatgtataatatagtgaaatttccccatcagtgtgttctgtgtattttctcca | 61110 |
| gctctttcttgaattacaaacagcagttctacaacttttaccacccacacacacacatttattcatttgca | 61180 |
| catatttcttttagtgtttttttttttttgcaaaattggcatcatattaattatactactctgcaactt | 61250 |
| gctttatttactgttttaatatggaaattgactgaagttaattttcaagcagttgtgtaatattgattg | 61320 |
| aacttaattgatatactataactgattaaactacctcactgttatttggaacacttatcgacaacactgc | 61390 |
| agtgtaaaaccctctttctacttttgcagctttatgataattctataaataatcagacaccgattgtgat | 61460 |
| gcaatcgtatcacaaattcaaagacacattataatgtcagtggaataagttagacatacagtgccaatta | 61530 |
| actcagggttccaggggtaattcttttcgtattgatgaaacgcaaatgcatcttactcattcagagttgc | 61600 |
| cagggccctggtgtagaaatctaaatcataaccaaaacaaacagcatcaccacgaagaaatcaacaaaaa | 61670 |
| caatttcatgagggttttgagtatttgaataatattttcagtaattaaattttaaagcaagaactgacagg | 61740 |
| tttgcccaccccatccatcctgtgatgtcaaatgcacggtatgtatctggctgacagggaaattgaggta | 61810 |
| ggaaaatagaatagtaatatgctattatgtacctgcgcttcagtttgaggaggataaaattgttttaac | 61880 |
| cttatgtccacattcctggagtggtttgctagacctgcatcagaaaatccacatcttagttcttcagctg | 61950 |
| ttcacatctcaatccacacagccttttgtcattagcatgccagaaatgcactacattcatgaaaggaatt | 62020 |
| actagttacatcatggtgaatgttagcatgaactctcattggcccataacattaaaatattcaaaacata | 62090 |
| caaattggctaaaatcgtttagagaaaatgttcacaatggcatgatgaaggtataaaaatccagaaatgc | 62160 |
| ctatgcctttgacctgctccagtgcccataacttgaagtctcttagtcctacgctcagccatggactaa | 62230 |
| ggaaaatttctcattacctgatcctgactgagaaagataaaagaacaccacttgttttgtccttaaagac | 62300 |
| ttgagaggcaaagagctacatgatagaagttgtacctctcacaagtttatggaaggagacatatgaactg | 62370 |
| ttttctgtctgctgtggaagtcagatgaatgactgcctatatgtaacacattgggcctgagacacac | 62440 |
| atgatgaggggaggaattacaaactatcactggtctccttctttttctgcgattactgttaccttaccta | 62510 |
| acagtaggtaactgtaatctaaaatgaacctaaaaattgtgcatgaacaaattagctcaggtagcttgca | 62580 |
| acattgactttacagtttgacctaggggagccccacgggctgaacctaatgaaactcagccaggttatat | 62650 |
| taaaactgcgatagcctgtatctctacattttctgcaacctggtttctacatagggaaatgctgcttgtg | 62720 |
| tttgctgtaggcaaatcttaaataaaccatgactcagcaagaagaagaagaatgatgtgcagagatatttt | 62790 |
| agggaagggataagatgcagtttgaatgggagcccacatggtacaagtactcatattccattaccaac | 62860 |
| ttcaggagcttttacttgaaaaccattttcaccttattcagtaatatgtcaagcatttcaggtgg | 62930 |
| tctgcaaaagccacatagctcagaggcttagcaaacctcctcagacatcaggcagaaacactttctaaac | 63000 |
| cccttaatgagtgtcaagcaggaaattgtgagtatatagtattaaggagatggacttgctattcttaaat | 63070 |
| ttacagaaaaaaattctggattttcttcctcagtctccacttaatgacagattttttttaacaaaaaga | 63140 |
| tgcatgacagtaccctatttaaacttactctgataaatttgatgaaatattcttttttttaatccagacatc | 63210 |
| tctatgagtttcagaattattacccttgtcaaattcatctatgcttttttttgtggaaatgttcaacttttt | 63280 |
| gttctcactgctccctgccttcccccatcaacaaaccctgaatatctgggaatttctcaccagctattat | 63350 |
| ttaactccattccacatgtccatcagatgtcctacacaagattggttaaatagaagtttgttcgctggga | 63420 |
| gaagatgacaactttttatattaaatgcataaaaattttctcaatactgcagggtgataagacaaagaa | 63490 |
| aaggccaatttaaaggaagtctttagaaaaaatacaataaagcagaaatgcttcactttcctacacaat | 63560 |
| agggaaaaaattttaatgcttttgcaaaaattaaactctaatgatggaacaaagttttattttatactggg | 63630 |
| taaatttatgttaggcatgaaactacataaaaatatgtggacaacaaagagtgattcagggctgcttaat | 63700 |

```
cgctgttgctcttggtgtggttttaggggattgcataattggtgagttccttacacgttgatctctcag         63770
attcaccaggcaatacataccagctgtcttggtaaatgcatgaaatgttgcaatctttgcaagtcctgca         63840
attttacttcaccagtaactttccctggtcaactaacagtatctagagatcaggcagagggtgaccaatg         63910
gctgctctgacgtacacatggagatactgaaagatgtggagttaaggatatttgaataaatatttcatat         63980
aatgacaactgtctttgttagcaagcagaaatatccactgtgatgcaaaggcatatcctatgtcatata         64050
tatttgctgtgaaaggtactgattcgtgcttatgtgaaaacctcttaaatcccgaatctggggtctcctc         64120
tccccgtttttctggaactcagatgctaaagttgatacaggaggagtggactgtcccaaataaagcagt         64190
cggggaaaggaggatccattgcaaataaagggtaaaaaaggtacatatgaatagtatatctatttgcacg         64260
taatgcaggttattctggagggtattaaatatctatcagtaactatcatttgttaaaaaccaggggattcc         64330
caaggatgttagtggatgtatgagaaagagtttctggagatatatgtttgggtgtccactacgattgttg         64400
catttcttttcttctttgtctctctctgtctctgactgtctctctctctcagtttgcttctctttcccctt         64470
taaacacacacaaacacacacacacacacacagacaccacacagaatattcccaacttcttaacacac         64540
aacaccaataaaaaatgccaataatcagattgtaaaactggcagttcttttctttcaatgtggctttcta         64610
ttctattgtctctcacatatcaaagaaacaagaggacaacagatcaggatacattttgtcatgtttacat         64680
tatgtagtaacctgaaacaaatgcccagtgagtggagggtttcttagctttctgtcagttttcaaatgtt         64750
ttccctcctcctgcctccctggctttgggttggtgatgcacgtgctgctggtctcagagatgccgtgcgcc         64820
tgacaagagattttgaactggggcatagatgattgtccccaaagtgatctgctcagttcccataattcta         64890
cacatttcaggcaatggaaacacaatgagagagatagtttgggtggttttttggattgcaaacttaggcag         64960
ccacagtttcaaccagcaatactgattttctcagcctttccatttctacccagtgcataacttatataa         65030
attttcttccaaaacttcacaattaaactattccttatttatgaagttatcaatgtgtgtatgtcttag         65100
aataataattggtgtcatacaaaccagtttatgcctctttaacttttagtgctatgatcttaaaaatttga         65170
ctcccaggcaaatatagatataaatataaatatacatgcatttttttcttgagagtcaaaattatatatt         65240
tatatatatgtgtgtatattatatatatgtgtgtatatacacacatatagattaaatatatatatttcat         65310
attatatatattacagattaaatatatattatctatatttaatttcattagtcatattgttttctacagttt         65380
gatttccagttttgcaggactttgtattcatattcctgatatcaggaaagggtgcatattgacactacag         65450
ctcaggtggaatatttagaagacacatggttgtaattagttacttgctattctgtcttaaaaattttga         65520
gtgttgactgtttaagaatatcttgcattgctttccaaacaaatatactacacaagcagcatttcttgaa         65590
tctcgttgatctgtgtggtgtgttggtgtggtcttatacaggattttgtctttttttttttttagtgtg         65660
gttgtttctccttttttcctttaatctaacaaatattgaagtactttaaaatttttaatactggttttta         65730
tggagaatgagagtttcctatcatttttcctggggtaatgtcatacaatgcatttctgaaaaaaaaatact         65800
tcttaaatttgttaatgtctgattattttttctgtcattalttttgccacttttgctattatgttacattac         65870
tattccataaccctcctttgattccagcattgggaattggttttcatttccatggactcattactgaggtc         65940
cttgtttctttcgagatattaaacctgacccctgaatttttttttcttccctgtgagagtggaaattataat         66010
tcttttctactggttcaggaaaaaaagaaactttactttctaaagaatatatttcttttttatggtcagat         66080
acgttttaaataaaacgaaagcttttcaatatctgtctgtaaaagagcagggtttggaattctcattggtg         66150
atggatatgttttattttcttacctgacacgtcagctactgcgctaaagccagtgaactatttctatatc         66220
acttactgatgaagaaataaagggctctctcatgatactaagtgtattgctgttccaccatccggatatt         66290
tttggcttaaaccctgaggtgttaccagatggtaaggattttagaaatgctaaaatgataatagtaggga         66360
ctactttcgatattgtgaagtcagatatatcattgcaagttttaaaaaaatggaatatttttatatttta         66430
agtatctgatttaccttaataaacactttcatcaatttcaagagcatctacatgctacattctggtcctg         66500
aattttcatggttaaaataaagccccacccagagactagctaataactatcgtgatcaacagtggacaga         66570
aattcagagatactagttatggtaacatccttttaatgctggagccttactgtcatagaaacatgtgaatg         66640
tcaaactaaaagtttaaaagccagatatttcaaaagagtggggagtgggagagtataaattaccccaag         66710
gaccctggaagtgctagattctgggcaagatccagatatttgcaatttgtttaactcccagttgaccatc         66780
tgagaaatattgagcaagagacagagagagagagagagacagagagagagagagacagacagagag         66850
acagagacagagacagagacagagattgccagggaccaagggatgatgctagtgaaccattttagctacaa         66920
agtgtcaatgtatgaggctggcgtggtggctcatccctgtaatcccagcacttttgggaggtcgaggcag         66990
gaggattacttgagcccaggactttgagaccagcctgggcaacatagtgagacctcatctcttaaaaaaa         67060
aaaaaaaaaaaaaaaagttagccaagcatgctggtgcctgcctgtagtcccagctacttgagaggctg         67130
aggctggaggatcattgagtcctgcagttggaggctgaaatgagctgtgattgcaccactgcactccagc         67200
ctgggtgacagaacaagaccctgtctctaaataaataaataagtactatgtatatgtgactctccagcc         67270
ttgcctagtccccagaagccttgcaaccttccaaaacttgattgttttttctcctaaatttctcagataat         67340
tgaggggaaaatagagctcagaatttgacaacagctgtccacatctcctggaatccctggcagaatgctg         67410
gtgctgtctcttctctgggtttcacagggcgggcataaattataactttattaggttgagcacatatggc         67480
ctttagccccaggagaccctccatggggctgtcgttggcagggggcagcttctgcacttttcattcaaat         67550
tcacaatccataaggaaaaagaggccttcaaggctgcagcctgcctgggcttccgtggggcatctccta         67620
tcattgccaataatgctgtggtgaaacccaggccaaatattccaacatcttttgctgcttgtatgaaca         67690
cgatgcatattgcagttcaaaactaggaaaaaagaagagcatattacaggcgaacacgaatgcatcagaa         67760
tatggtacctttaaattaaaagagaaggctcttgattttgaattctcaagtgtttctcttcaaatacaca         67830
caatgatgtctttcactttaattttaactattatggatacataacatagatgtatatatgtatggggcacat         67900
gcagtgttttcctacaggcatacaatgtgtaataatcaagttagggtaattggggcattcatcacctcaa         67970
gtatttatcccttctctgtgttaagaacattccaaatccactctttagtttattttaaaatatacaacaga         68040
ttatttttgactatagtcactctggtgtgctatcaaatagtagatttttttttcgaggcagggtcttgct         68110
ttgttacccaggctggagtgcagttctgtgatgatagctcactgccgcctcaatctcctgggctcaagca         68180
atcctcccacctcagcctcctgagtagctgaggcccacaggcacatgctaccacagctggctaattattat         68250
tttttttaattttgtgtacattaggtctcactgtgttgcccaggctggtctcaaactcccgagctcaaatg         68320
atccccctgccttgtcctcccacagtgcaacgattacaggtgtgaacctgtgcccggctgataggaattt         68390
ttgatggagttcccaatatctgggctttcaaagattttggatagtgaacgagatactgcaaagatctct         68460
ctaaatatcaccagcctgaccagggaccttgtgttacctatatgaatacactgaggttgctgtctgtttc         68530
tctgttaatgtataagcagagaaagttacattgatgctcatcagattttcagtttaatatcagagcattg         68600
caaattaaaatataaggtgcgggacatgtacaattttactgcggggcatgcaaaacctgagggccccaa         68670
agcagaagaaggcattcggcctctagtctgcatttcctccctcctgagttgccagccagccagccagcct         68740
gtcttacagattccagacttgccagctccacattgcatgagccaattccttaaaatagatcaatttaat         68810
```

```
aaatttaacctatattggtgaacaaatttagcagagaactttgatatacattagtaccacttattatttt      68880
tagaaaaattggaattcgaataactaacactaaagtctaattcgtcatctggtgtgtatgttataaatgc      68950
acacccactcaccgagacctattcacagccacagcctcatataaaaataggcaatagatacaggaaatga      69020
gaagcagccatagagggtcttacgtaagaaaccccatccttctcacacctactcaagaacgttgttccca      69090
acatctacatcttttgtagtttatatccactgggcgcacctaacatcacatccacattcttttgtttatc      69160
ccgtttggaaatacgtgcctgaccttcactttctctgcctgatgtggctgcatgttttgtttctctggc      69230
aaccatctcctcgtcttccaagagtcctcaccgatcacatctcaactcctctccacctatcctttcttaa      69300
attcactccaatcagtatatagcctcaccacttcaccagactcctcttgccaattataccattgcatcct      69370
aggccccacaaaagtggagttgctattcctaatgctttctaaaaaatggccattctgcattttccctcgaa      69440
tctccactgcctctattttggaaaagagtttcatctttgaaaaagcatttaagaccaactttttcccca      69510
ctctggagggaaatgaaatattgctgaatgcagaggatatctccaaggcttcatactacttgctctggca      69580
atatttccagatcctatcctgcagcatttgcggtagttgtcccctagaaatcatagttgaaacctact      69650
cctcaactgtgtaggtatttggaagtgggctttggaaggtatttggagagtggagcctcatgagtggaa      69720
ttcctaccattataaaagggaccccagagggcaccctcgtccctttatcatgtgaggacacagcaagaa      69790
ggcgctgtctatgacccagaaagtgggtcctcaccagccactgaatctgccatgccttgatcttggactt      69860
ccggtctccagaactgtgagcaattttttttacaagccgtgggctctgcagtcttttgttttagcagcca      69930
aaagaggtaagatagggcatgttgggaaggaatggagatgtccacaaacaccctgaatcatatactgctc      70000
cccaaccccccgtcctcccagcagagagagcaggaaagagaaggcttacttcctccaggttcgatgctct      70070
tctacacacagttatgacagacacagcattgccttatattttattctttttagttcatctgaccaattgtca      70140
aattgctcaaatgtcagaaaaatggctcaaagggccgctatggatttctgcagtagaaaaagaaaagaca      70210
gaagactagatcccaatgtgttcctggactggaagaaagttcttattttatggagccataaataaatatg      70280
acatttcttgtgcctgagaatttgaggcaggtagtactcctgtgaagtaagataatgtcttctgtaaaag      70350
aataaattcattaaaaaccatgggaatcattgtaagtttcattgtcaagaaagaaacagacatgattttg      70420
gatgtaggtgaatgttaattattgaagatgattattgttctcagaacaagtttattctgattcgtagcca      70490
cagcagttcaagagaaaagcaataaaggaaccacaaccatatgacccttcttataatcatgttgtggtgg      70560
ggatgtttcttctccgtcctacttcctgagaatgacagaagggttttgcaagagtgaaggcagctgggaa      70630
tatattccagccgcttccatagttcatgctgtggtaaggagtttcaaggtcacagtgaggcaaggagttt      70700
caaggtcacagtgattgaacactagaacttgtgcctctgttctctgctgaacgtcttccatgactgctac      70770
atcagggcttggggttcccactgacgtggtgtttaagtaacatttagagtccttatggttatacactttc      70840
atctccttgtacagaaagtttctggaaactgcccactattatatgacacatattaacctgttgaatttgg      70910
ttatttatgtgaggaaaccacagaaaaccataacaaatcaaaatacctaagagccacaaatttcctccag      70980
tgcagccacatcccatagacaggtaatgtgcactacatgtgtaattttaagtttctagtagttgcattc      71050
aagagtgcccgaagaaaccattgataccaattttaaaaatacattaatgtatcccaatatttataaagt      71120
actaagtcagcagcagcaataagacaaaatatagtttgcatattttttactacatatttgatattcagagt      71190
acattttacacttacaacacatctcggtttgaacaagccacattttatgtgctcaatagccacatgtggt      71260
tattggctagcattttggaaaacacagtgctagaaatgcattcttcctgccatgatcaaccattgtctc      71330
tcacttactcctgggcaactgtgttctaattgattcccgggcattgattattgccttcagggagaacaa      71400
ctgatcaccgtattatagtaggtcattcctacacatggccttccaggtcccaaacccgtctgatttgctaa      71470
gccgttttccctcttgtcatgccatcttcccttcatttgctacattccaggttttctagtctaatgcag      71540
tcactccaggcactctgtacttgtactcagcatttactgggtggtgtatatctgtcgtaggctgttggtt      71610
gtaagtttcatgacagcatacactatgcctcccttttttccacatgcaccaatccatcaaacctcattgag      71680
gacataaaacagcatataaagcactccatcgattgaattgaattaatgtgtgaacaattgcacctgca      71750
agtgtaactgagggctcacgtggttgtcatgtatcattttttaaaatgtttaaataatgcgagtttcatc      71820
tatattcttattacttctgtagaaattaatctataatatttcaacagtaacatggttgaaattgaggcct      71890
tatgtaatgttgaacacaaatgataacttgattctgaatcaacactgtatgtgcgatttgatgtctgat      71960
gtatgatttggggcagtttgagggtcagtcatttatttgtactgagcctctcaaattccctgtatgtgaa      72030
gggaacagttgagaataagtgtcttcagtggataaagacagtcgtcttttatccctggaaggcatcaccaac      72100
tgatcacagcagtctgttttttctgagtcaagaggcaacttcccctctatgtaggatactacttttagtgt      72170
agtgtgctcttccatatctattggaatcattacacctgatcaatcagtttaagataaagggtgtgatag      72240
atagaaatggatgcagatgctcttgcaaattgagttgaacccttgtctttgcatcttgtgctggcctca      72310
gtgactgtcttcttgaatagaatgttctgggagtaaagcactggacttccagggctggatcataagaag      72380
ctattaagccttccatttagggcacttggagtactgaccctcaggtcccaggcattctctcttggaaaccacactc      72450
atgttgcaaagtgttcaagccccatggagaggctatgcatggtgctccagtcagtagctttagcttcact      72520
cccggttgacaaccattagtaccgccatgtgagtcacccattgtggacatcccagctgattgaggactcc      72590
tgtctcttcctatcccttagctgactaaggagatctcaagagagaacttctcagctaagcccagtcagct      72660
cacagaatcatgggagatcctcataaaaggttgtttgaagcccacacattgggcatgttttgttacacaa      72730
cattagctaaccagagcaggcactgaaactggaagtgaggttctgtttcaacagaaacctaaagtacatg      72800
gtgttggtgttggaccctccatagggcaagactaaaggcttgaagaacaaggaagaaaattggaggctg      72870
gggaaatggaatggacaaagagaactctttgaatgactcactcacagccttacaggacgagaagtaactt      72940
ttagcactgtgcaactgcaagcaaactggattttgtccttttaaaatagaaagatggcatctcaaagaaca      73010
catttgtcatgagtagttcctaataagcataatacttaacataagttcactggcgtatgttatttataa      73080
tcttactatagtataatttccattggatagcaaaaggtcaaggatataattacagaaatatattcttta      73150
aaatttcttttggttacacttaaatgtaaattgtgaacaccatttattttctattgtatcccatgactt      73220
ttctattgtttgggtcatatttaaatctatttttacagtataaattttgcagcatatattcccacaggaaa      73290
gaacaaattataaaacacacagtttgtatatgtctttcctttaaaagtgaaattttaactagttttcttt      73360
ttttttctgttactatgtcttttccattctttggttcaatacattttaatgtatcccaatatttaaaagt      73430
aaagttggcaatgacccttttaaattcttttcagtctctatctgcctaacatatatttaggttccgtatat      73500
atttatatcatttcctacttaaatacacatatttccatttttgtgctcatgctattctgcaaatgcctgc      73570
attttaaggatgagacatacatttaaaaagggcatctatgccttctttcagaatttttttttctaaatatc      73640
tattactttgatatttgaaattttgtacccacaaacatacacatacacccatgtgtgcataatatacatc      73710
tcacagaaatgccagccatgtcgggaaatgacagctccatcgaaatgtctttcatccacgtaatata      73780
tcttatttccttgtataaggcacagatcctctgttaccaatatcaacttatccccaggctctaaatcact      73850
tgaagctactttttgattctctggagaatttcagaatatattttttttcctcaaaatttcatgaacttgtat      73920
```

FIGURE 8A-56

```
gcattttgtgcctcagactttgaacgccttggacaaattccttatccctgtgaatttttaacgaattct    73990
aaacaaaatacctgactccacttcccccaaatttcctgaccttgcgtgcattttgaactgcagacttg    74060
aaaacacttgtgcaaacgttccttcatccctatgaatctttaatcctaaacaaaatgcctgtatcaatgc   74130
tggcaaggttgtggagaaaagggaatccttatacactattggtggaagtgtaaattggttcagccattgt   74200
ggaaagcagtgtggccattccgtaaaaagctaaaagcagaactaccattagacccagcaatcccatccat   74270
tactgggtatatactcaaaggattataagttgttccatcataaagcacacatgcgcacatatgttcattgt   74340
agcactattcacaatagcaaagacacagagtcaacttaaatgtccctcagtggtagactggataaagaaa   74410
atgtggtacatatacagaatggaaaactatgcagccataaaaaagagcaagatcatgtcttttgcaggaa   74480
catgaatagagctggaggccattatgcttaaccaactatgtcggtaacagagaatcaaatactgcatgtt   74550
ctcacttataagtgggagctaaagatgagaacacatgatcacatagtagggaacaacagacactgggcc    74620
tgctggagggtggagggtaggagagggagaggatcaggaaaaataactattgagtacttggcttagtacc   74690
tgggtcatgaaataatctgtacaacaaaccccatgacactagtttacctgcataacaaacctgcacatg    74760
caccccctgaacctaaaataaaagtttttaaagaatgccagtatccactacatttatgggcggtctttctga   74830
gtttcacctcagagaaacactcctaaaattcaagttatgactatttagactatttgttaatgatagctct    74900
gtgtgtgtgtcttagccccctctcgtttcctatgtgttctacttgatttttaaataaactataggagct    74970
ccacatactaatttgattctctacataaaatggtgccatattctcttatttttcctttaggatttgtaca    75040
gagactgtacaaaatatttttgagttgtgtaatggtatccaatatggacaataaatgataagtaaattt    75110
tggaaaaatcagttaaaagaagtgtaatagatacataggtgtcttaattgttttccgtcctcaagtatgg   75180
acgtttttgcaaagacacgagctttttacttcaggagacatttgtcgacgtctggaaaaaattttggttg   75250
ccacagctagatcatgggggtgggtatcacttgcatctagaggacagaggccaggggatgcttttaaggga   75320
cccacaaggcacagaacagcccccccatgacaaagagtctttcatctacatgtgtcaatatcgatgagatt   75390
gagcaacccaggtatagagtaatactgatgagcacaaagtatagcttgaagcctcttttccatatggct    75460
gtgatagattgttttaaatgatcattgtgaagaaataaaccctggttctatggaagtcatgaggaatatt   75530
ctgcccatgtgcttgtgaaacctcagcttggagcaaagaggcgaatatcatgcaagtggcttcctagaat   75600
catgggtttttgtacagattatttcatcatccaggtattgagccaagtacgcattagttattttttgat    75670
cctctccctaccccaccccttcaccctcaagtaggccccagtgtgtgttgttccctctatgtgtgcatg    75740
tgttctcatactttagcttccgtttataagagaggacacgcagtatttggttttctgagctggaggccat   75810
tatccttagaatcttctatgttaaaaacaacagagcacctcctggctttcctgggaatccttgtttcctg   75880
attccagacaagcgccatggctgtgaaatcatgtatttatgtgtatgctgttggattttaatgtgaaata   75950
ccttttcactcgcgccaagttcgcttccaaatgtgatcccgccaggctgaccaacaaggcattcagtcagc   76020
ctactttcttatgccgggaccttcacaaaatgaatcatatgtcacttttcttttcagaagcatatgcca    76090
tttattttattctgggagtttgaatcacaccatgcatctgtttagtgttgttttttagtaagttcacta   76160
tcagtgcttcctgagcatggttttctcgtatgggtactcactgacctgtcccatccatctttttcttcta   76230
taaagcctttactgctatacttgtctacttgcagaacctccacactttttatgagctcccattttctct    76300
cttcttggtatttatcattacttattgtgactcttgcatattggatggtcaaaagagatccccagtggtt    76370
acactacaacaagataaatgtaggtatacttttcttaattgttattagtgttacttattattttgtttta   76440
ttagacactacttttcaaaggcttttacagcactgggtatgttctacctttttcttttcattttatcctcc   76510
acaacagttctgtgatgaaagtactattattaacttcatagtttacacgacaaagcatggttttcataact   76580
tgtcaggatttcttagccattatttgataaaattaggggatctaaattctgtcttctagctccaaacagat   76650
ggttctttccatgctatttgctattatcttgtcaaaagtaatgacaaaatagaactcaaatagtattttt   76720
cttttggctgatttcttctttcagaccagagaggtttccaaggttaaagtagttcattaatttcaatttc   76790
ttcttcttttttttttttttttttgagacaggttctctgtttcttttgcccagttgggtgaagcaca     76860
gtgacaccatcatagcacactgcagccttggcctcctaggctcaagcagtcctcctctcttggcctccca   76930
aagtgctggaatacaggggtatgccaccatgtcaggctacttttatttttattttttaagagacagtc    77000
ttgatctgttgcccatgctggtctcgaactcctgggcttgaacattcccctccttgacttcccaaagt    77070
gctgagattacagacatgggccaccatgcctggccttaatttgggtatcttctaattgatgtggactctt   77140
atgccctattcatttgtcgttttgaagtgaactgactctgaatgtcagtgatagggcactgcttagtgttg   77210
ggggtggtaggaagatatgcaagtttcttagagaataaagcagcttgctgttcacagcagagggggtgt    77280
aactgtttcaagaatttttagaatactactgtctgtgagttctgcaagaagttagggaagcctcccactcc   77350
tggttagactggcagcaacttttttgcattataacacaacagacatttcatgtccaagccaggtaatctga   77420
gctaccccttgttcattccagatccaggggttggtgaggcaaaaagggtgtccccaaaatagatgggtctct   77490
ttattgaacttctggggttatctccatcatgtacagagatacagaatcatgcattttataaactttatggtt   77560
gaagatggcacccacagttacagtttcctccccaaacctccctggcctatctcagttcttaaagatgtctg   77630
gggattcccagttaggcatagagtaacaaggcagctctatccttaaatgatcatggcaagctgccatatg   77700
gctggtattcatcctcagttaatgtggatattctagtaggagggcacagtgacataggaagaaatggtca   77770
ctctgtgttcaaattattccttaacttagaaggcaagtttaccaccctgtgggtactgagcattgcaga    77840
cttcatgtaagcatattttttgagcatttttctacaaaccctcatttctccaaatcccatcctttgcaacct   77910
caagtttatccagggattcacactgcctgcatgtccttgtatgcgtttcttattgttcctgtaacaaat    77980
tatccaacctgtagtggcttaaaacacacgcatttgttatctccaccattctgaagctctgaagtgtgagt   78050
agctcggatggtttctcttcatcatcacccaagggtgatttctgtgtgttggcagaaaggctgtgtttct   78120
tcctccagactccagggatgcatccacttccagggaacatttgggtttgatggctacatccagttccatgg   78190
gttgaggttcctgcttccttgcaggctattggctgagggcaaattttggcttcttgagaaccgtagcatt   78260
ccttgactcctggcctccttcctcccccttcaaagccagcagtggcagcttctaatgcactgaatctctc   78330
cgacttcctttttctacctcttgtctcctttcccaagttgcatggcttgtctggactgattgttccattac   78400
cattttcctgcttctcagtatcatggacccacttggatattctaggataatcagctttatcttgacatcag   78470
ctgcctagtaaccttaattatatctgcaaagacaattcacaacagtacctagattcatgtttgatttaat   78540
aaccaggggaacgagaatcttgggtggatgactttataattctgcttaccacattcctgtctataaacta   78610
atcttaaggttggtggacaggccccttacaactgactttgagtacccagaacactggcttcctatcttta   78680
ctcaaccagtgggctcctccaggaaaagcccaatcaaggaagataacgccattattctcatgcttttcct   78750
ttcccccttccctccccttctctccctccccttctttccttccttctctctttcattttgagac        78820
agagtctttctctgtctcccaggcaggtggcagtggcgtgatctcggcccaatgcaacctctgcctcag    78890
cttcccgagtagctgagactacaggaccgccaccacaccacctaattttctatttttagtagagacg      78960
aggtttcgccatgttggccaggctggtctaacctcaggtgatccacctgcctcagcctcccaaagtgctg   79030
```

FIGURE 8A-57

```
ggattccaggcatgaatcaccatgcccagcatgtcatgccctttcgaagtctgggtaataatcctcagat      79100
ggtagtgcacatagttatggagaattagtgaaccactcctccctgatgtggctcgcccccactgcaaata      79170
atttgtctatttttatttttattttattttattttattctttttttgagacagggtcttactctgtcgccca    79240
gtcttgaatgcagtggtgcaatcatagcccactgcagcctctacctcccaggctcacgtgatcctcccac      79310
ctcagcctcccgagtagctgggactacaggtgcatgtcacctcgcatgactaatttttaaattttttgtt      79380
gacgcaggatgttgttatgctgcccaggctggtcttaaacttttaggctcaagcagttctcccacctaag      79450
cctcccaaagtgctgaaattaacaggtgtgagccacccagcctggcctattgtccttttttaatttaaaa      79520
gactcaacatgtagaaaccattttacccctcaccttgtgcattaagagcttccttttttcttaacatcct      79590
gctccttgaaatcaaccccactctacttgtatggcagttgttatttttaatatttctaattaagatacagtt    79660
ttcatttttaccttacagagacagtgagcgggtgctcttgaattccagtctggctttctccattcctttgg    79730
gtaatcacaggttaacttttttccttcatcagttttcagcagtcagtgaaaggtgcattcattttcataa     79800
atcagccatttggcaacatttgaatgtttaatcagtttgcgatcacatcaaagaacaagggaagttcttg     79870
ggagatttattacctcctttggaatctgtgttcttagctacaaaggtgcaatgacttttttctagttctct    79940
gccccagatgtctgaactgttaatatttacagtgctccttttcctgaaattcagagtcagcacctcattt    80010
atcctatttgtatcccaacttacttttattcaaagagattttacaacctgagatagctccgtaggaagagt   80080
tcagttgtcagaagcaatctgatccatggaaattttctggtgtttgttttttccttgaattaatttgcagg   80150
tttaaattcttgcttaggccactctaggacttttaattgctatttcttaggaaatattccttagaacatg    80220
aagcagtctgtctttcaacacacacacacacacacacacacacacacacacacacacacacacacc        80290
ccctagcatacgatccagaacaacgttttatctttttttttttttttgtaggagggagtgtctcactct      80360
gtcacccacgctggagtgcagtggtgccctcatagctcactgcagcctcgacctcctgaacccaagtgat    80430
cctccagcctcagcttcccaagtagctgggactagaggcacacaccatcacacccagctaatttaatttt    80500
gaaaaaactttttttttttgtggagacaaggtctccatgttgctttggttggtcttgaattcctggctca    80570
agtgattcttctgcttcagcctcccaaagtgctgagattctggcgtgagccaccacacccagccctaac     80640
attttattcttttactgactgtgagattttcattgacttacgctatgtcaggcagacttttcaagccata    80710
acctggctttggtgatttattatttttagctcttcatgttttaacagcttctctgctaccatgataggtta   80780
taataagtgatagaagaaaggcattttaaagtaatttatgaatgtggatctcatttgcttagctaaaaa     80850
aaaaaaagtttttttttttttctagagaatagaaccaaacagtgttcactgtatcacatattccttttagt    80920
gtattgagcattaatggggtattttgcagcatcagatcttcacaaggctgggttcatcagcagcacag      80990
tagctattaggtgattttactcaaggcagcaaaattcgtttcttataacacagtctctattgaagacaca    81060
ctctaaggcagtttgcctcatctatttagctttccaaaattctctcttaaattgcagtttaatgaataga    81130
ctaaaacacaaattttaagaaaaatgtagttataagatatgaagtgtctttttaaatctgccagtggttta   81200
agggatagtatacatttaaaataaagttataggcactgatttagtcctggaaaataatggctttatttca    81270
ataagccagtatcagaaattagtttttgttttctttttttcgtgatgaaatgtggtttctagtac        81340
tggataagaaatgcatgagaaataatgtatcccagcatatttaatatgcaacagtgtgatctcagtagcc    81410
ttgcagatggctgagctgaggcactaaaagtgatgagatgacatttgtatttttccacacgttcttgcc     81480
cattctcaggtgagtctgggctctcatcagtatttaaatgctgttttaccttggcaagacatttaggtcc    81550
agaaaatagtttaaaaaattaacatctacgcagaaagaacctccaggtagttaaaaataggggcaatttgc    81620
ggatacaccacatcctgaagacttagtgttgctaagtaaaccacattatttttaggtgtttcttcctgaca   81690
ttttttatttttttttcttgtgttatttttaattctggaacataactgggaactgagaatactacatgggaccc 81760
ttatctctttttctttgttatgactgaaaatcataatttgaaagatgcttggaaaagggaaagcttaatat   81830
cttacacatatttttataagacaaaaatatggaaagatatgaaccataaaatcagtttagaatgggaagg    81900
gttagtaaaacattttttttgagcagaaaaggaatcatggaatggacactttataatatagtaattcagc    81970
caatttatttgatggaattcaaatgtcatgtcctctttgtagctaagagtgccacattagcattaaccta    82040
aaccagaccacttggagccaaagagatgtgtatgtgtgtgtgtgcatctgcttctgtgtgtgtgtttg      82110
ccccatctgagtgatttgattttttcaccatctctctattttccacttccaaaatttaagcatttagaca    82180
tttattatattaaatatgtttgcattctccctccctccacatgcagtgttttacaaatttcctatcagac    82250
tgttcccatcctgcaaaccccagagctctatggctgaggtactcctccttttctgttcccttctccatgca   82320
gatggaatgtctgctgggaactatcttcaatctatatttccccattcgtagagagtggctaaatctgtga    82390
catgcatccatcctcatccaatagtgtctccacatgagtgagctggataatgcaaaaccaagcttcgaca    82460
tcagtggtatgaagtacacacacacacacacacacacacacgcacacacacaaatacaaacacacata     82530
atctctgtagctcagattgggattgtctagggttaatatcttttgtgctaaaaatatccctgtgccacat    82600
tgaagcttattataataattattaattactgatatatttcaactgttatgtctcctaaaaatatgcatag    82670
attattaagttttcccttcccttgtgttttttctgattatgatttttctatcataaggtgaaagtgataa    82740
gggtcccatgtagtgttctaactctaaacctaatactgaccctaaacagaattgaacgctttaaactaac    82810
ccatggcctttgaccattgcttcttgaccgttgagttaacccataaccctgaacagagaatgagaaattg    82880
aacccaaatttgaacccaaaccctaactagtgactggatatgaaacctaatcctacccaactttgaaaaa    82950
gaactcaattctaaactcaaaagcaaagccaaccgaacacctaatctaactttaatgtaaacctttgaac    83020
ttacccttaacttttgccagtagccctttgactcttgaccccctgatctgaacactgaaggcatccccaaa    83090
ttctccgacccatggcctttgatcctaatcttgacttttgatcactgtcccctaataatgaatataatccc    83160
ttgatcataacattgaactttgctcctaccctgacattcaattagtgatctaaccataccacaacctgaa    83230
cttgaacccaaatcctaacatgaaccttcctccataccctgaaagctatcctaacccttgacctttgatct   83300
ttattttctccttgactcctgactgtgagatcccagcctggactaaaatgtatacacacctcaaaatc      83370
tttttgttctgaatcgttacccaaacctgaacttgaacccaaaccctaccccaattacaaatct         83440
gaatacaaaacctatccctattctaaagttgggggatttgagtctcttagtcccgtagggtagatgtggtg   83510
tttgcagccctgcagccactatggacaccacagacttggacaaaatctccaacgtattttttgggaaaaaaa  83580
ggatgcaaccattagagaacaagatgttgaaactttcatccataatctctgtttgtacagacttcagggt   83650
gaaatacatgtggttggaattgtgatatttccagccacaaaattgtattatgttgagataatgtgggttt   83720
ccctatccctgaaaatgtgttcatccaaccaatagttacttgtaccagcagtgcaccaggggaccattttg   83790
ggttcctggaggcagccgtaagcaaaagcatcccagatccctgcttctggaatccctgactgtgaattg    83860
gcatcctcataatgaatgtaataaagaaataaggtaaataaagaaataatctagactcaaatgtgaactt    83930
tagtcgctctggaagtccaaaccctgtccaaacatgtccgccgattactttcagaggatgggtgatgact    84000
caggttaatatggttattttttggagcccgtcttaccctattgtcctttatagatgatgtgttttccacctc   84070
agatatcaacatgaaagactgggtcacttctcaattcagaaatccactcaaggttaggcactttgggagg    84140
```

| Sequence | Position |
|---|---|
| tcgaagtgggaggatcgcttgagcccaggtgttcaagaccagcctggccaaatggttaaatcctgtctct | 84210 |
| acaaaaaatagaaaaaaattagctgggtgtggtaccacctgcctgtagtcctggctgcttgggaggctga | 84280 |
| ggctggaggatacctgatcccaggagtttgaggctgcagtgagctgtgatcatgccactacactccagcc | 84350 |
| tgggcaacagagtgagaccctgcttaaaaaaaaaattcattcaactatgtgtaagagagagagagaggtg | 84420 |
| tttattagatttaactgaggatttggggagaaacttgggggcatttatcctatgggataagagggaaaa | 84490 |
| ataaaccttttaaattaaacatctcgcccttttgctgactaccttttggctatcctaacatgaaatattc | 84560 |
| ttctggatgctacaactctcagctccactgatcggctagagcagattcaccatcacttcttgttttgga | 84630 |
| tttcaccctctgccactcgtgatttaacaaataattctctgaaaggcagttctctttgaaaaagagttt | 84700 |
| tgcttctctgtgttaaaataatgtgtgctgctgttaaaatagttttgtatacacgagggaactcctttag | 84770 |
| aagctttatcacgtctcttagctgtgcgtgcaatttgagtaattactatgtaccaattccagtaacatag | 84840 |
| ccaatacatcagaactctcaggggacgtagctgggaactttcttgcaaaacaactcccacgtgttcattc | 84910 |
| ctgtctggaaaccaccagtaaaatttataatcagtaataatttctccaggcacagcaactgagaatggta | 84980 |
| gaacattagttttaaaaaccattttaataaaatgcctttataaatattgagacttaattatttagattaa | 85050 |
| tttgttccagttaatgaaagatctcttagcacaagactgggaaaaattagaacacgtataatttttcttca | 85120 |
| ttcccagataaacaattattttaatgtttatctggtatttgaccacaaacttaaattcctgggtttcgtag | 85190 |
| gattagaaattttaaggttagtaatcactcccgttgttaaactgctggatttttacctaaaattactgcaa | 85260 |
| ggatgtatcatttttttatacctcaagctgttttgtgcagttctgcttccaacttccatagacaatttta | 85330 |
| atcatttattttgttttttcttatcagataatgtttcataacatggatgtgaagaattaaatgaacatc | 85400 |
| cttctgtgcacaaattaagattagaacacgaagattttggattccccctcagttcctttataaattgta | 85470 |
| tttctttggacctgtcctaaggataaccacttttgtgaatctgattcattatttccttcttttattaagt | 85540 |
| tttatttctgcaaaattgtcatgaccagcataacccaaagaatatattgttcgctctgcttttgatcttt | 85610 |
| tataaataggatcatcctatgtcttcttgacctggcatttccctttcattgaatagtatgttttgat | 85680 |
| tttaaccatgaagatgcttggagctgtagtttatttgtgttcactgatatatggaacctcacccgatggt | 85750 |
| tataccacaagatatttaactctttcagaagctggaaatttgaatttggccttatgtaaagagttcagcta | 85820 |
| ttaggattctgtgcgtgtctcttgttgaaaaaaaatgcagaagtttctccaactagaaatgtatttactg | 85890 |
| gaccatatttatgtgcatatttggatatacactctcaggttaaaaactgtttaagtggttggacagttt | 85960 |
| tattcacccaagaacagtatcagagttccctgtcctctctgcattcactgcactgaatccaaaattgaat | 86030 |
| agaaatgaaattagctgtctttgatttgttctctcttttagacaaaaggcttccaatgttgtatcattatg | 86100 |
| tataatgtttgaagtaagatataaataaactaccattttcagataaagaaatgtttatttcttttccttaa | 86170 |
| tttgataacatacaatcataaattggttcaaggcattttttcttttatcttgtaagattatccttgctttgc | 86240 |
| atttaattttttcatgtagcaaattaaataacttaacttcaaatgttaaacttagcttgatattcagta | 86310 |
| tcttctttaatactgtttttgtatttgttgttagatattaatcatttttttctatctctgtacaaaacaa | 86380 |
| gatagactataattttttctttgttcagcttccctggttttagcatcgactaatagtagctgtgtagaaag | 86450 |
| agtaagagaaacatttgtttatgctttctgggagagtttcatatataaacacaaattattcattcattaata | 86520 |
| ggtggtagacttgccattcagtccaccttggacagattattttctttgttgtacttaaaaccatcatttat | 86590 |
| ttcctccttgatttgtggactacattacatattgacttcttgtatatatgaagaaaaacatgtttgtatg | 86660 |
| tctgcacatgtctgttatcactctattatgttcccttctgcatttgtctgtctgctatatacatttgc | 86730 |
| taaactgtcataacaaattatgagaaattagcagcataaacgaatagccatttattacatcagggatct | 86800 |
| gtaggtcagaaatcctggtgcagtggagcctagcttggtcctctccatagggtctcccatggctgaaatc | 86870 |
| aagagattggcagggctgcattcctttctgggtgctgtagggatgaatatatcacaacatatagatttt | 86940 |
| aaaatctaattatttgcactaacttctgattttaccacattagattcatagggtgaattcctgtcatatt | 87010 |
| gatcattcgagtcttatggaagctttctttctatcttacaacatcgtcagattgttacaggtttcatat | 87080 |
| gtatttattcttatgcttaaacaaggggttttctctgttttatgtaaagtttgacctaatattttcatc | 87150 |
| atatctgtgttatacttgagatgtatattgtgaatatataagcacacacaatgaactattcttcagcctt | 87220 |
| aaaaaagaaggaaataagaaggaattcatgtaatttgtgacaagatggatgtacctggaggacattatgt | 87290 |
| taagtgaaataagccaggcacagaaaggtaaacactgcatgatctcaattatatgtggaatctaaagaag | 87360 |
| tcaaactcagagaaacagagagtagactcatggttgtcagggactggaagtttgggttcatgggggaattt | 87430 |
| tggtcaagaggcatagacatctttcttcttcttataatattatgttcctatgttctagtttttgagctat | 87500 |
| taggatttccatatcagcatttttaggtcttatttatgcttgcatttttttatattcttgataagtagtc | 87570 |
| tttctatatcttttgggtttaaatttgtctcttgagttggatgcattcttcatcttaggttttgttacaa | 87640 |
| acatgagattgtctgaaattttttttaaattcatgagtttaaaccatttatgtttgttgaacgttaatttt | 87710 |
| taccgatgcttattctgccatcttgttttatatgttcaatttagttacttcacgataagcgtaactgta | 87780 |
| cattttgttttgaaaacataagtttctacctgtcatttaatagatatttaaatacatagttatttaaaa | 87850 |
| ctctgttatctattttttatccttactatggttaaccataactgatcacaggggaatgctgttttattttttc | 87920 |
| ccagttgttttttataaattttaacaacataatattggttataccaattttgttcaatttctatatgaaaa | 87990 |
| tcaaaaatatatagaatacatcaaggaattcattgacagatctgggaatttctaacaagataaacttttt | 88060 |
| tcaaacatgcatcttttttagtcccacccctagtgctatttaagtagatatttccaagaatttaagttct | 88130 |
| gggctattatccatatatgattttttgtcttccttttttctacccattttagcccaaatagaaattatagtta | 88200 |
| ttggttgtgcttgcatttcatatatttttcagaattcttaccaaatagttatattcttttgataagtatt | 88270 |
| ttctcaaagataattttcagtctttaaatctttgcttagcaaaatgattgaatctcttttttgatcttttt | 88340 |
| ttttaacttggcctatagtattaaattttttttaaattcagagttattttcttcaaacttcaaatatga | 88410 |
| ctcctgtgtctgctaatgtcttgtgctatgactgggaagtttgatgtcaatctgattcctattcattcat | 88480 |
| agctcacccatttttctctctgaaggctattagaattttctgttttgtctttgatgttcttaaatttctta | 88550 |
| gtaatatatctattcagggcactctttgagcccattcaaaataaggtttttgttctattttgattttttca | 88620 |
| agtgtatttttcattctttcatcaacttagttcttcctctgtatttttttttctctttctgttacctgatc | 88690 |
| ctggtatctctaacaaagtcatccattttttccaaggatgcctttctctccttttattctttcctgatgctt | 88760 |
| tctgggaatttcttccatctgatcttccaatttggtaattcattctatgatttatcttaactattaggtt | 88830 |
| cttgttcatctttactattatttattctataccactatatttaccaagttctcttttacttcttattat | 88900 |
| aatctcctatttgaaatatatttccctttaggtgatcgaaatataaatagtagtttttttatttcagtaata | 88970 |
| tgatctgttccaatcattatatttaacgtagaagaattttttttttctgttgagagagagcgtttggtacc | 89040 |
| tttgtaaatgttcaggtatatagctctttgttaaacatttagcctgtgttctccttaggtgagtggaaac | 89110 |
| tcatccatcactctgtttgtaattacgcatgtgatgggacctaagggcagacccaagtctatgttctt | 89180 |
| ctatgagattaacattcaacaaacacttttagatcactctggcgcactgaagaagtttgaaatttgagat | 89250 |

FIGURE 8A-59

```
ttggctttaaactctctaaaggagccagcattaggaagaaacagcctctttagcttcattcctgggggtg          89320
tggaggggaaggggtgaaacaggaaaagcccatagtggccataagtgactggtggccctgaaagttttt          89390
aaccagctcctcaacgcagctgagttttccgtgggcttgccagagtcccactacctgatggctgccctcg         89460
agttctaagttgtatggagaagagacgatgggagggagattagacaatgattaactcaaggcattcttta         89530
taagagacaagagtgaacttaatactttgttttaaaccagcatctttctattaccacttccaccctctg          89600
ccagaaggtgcagccactcccattccacatatatacatgattcatcagcttgtaatctcctcgggatggc         89670
ttatagcttactgatttcatgttctattattgctcttccgcagattgatgcctcgtcttatcctctcta         89740
gttttttcaaaagtagatttctgtggaggaagggcattagttctattcaccatctcaaaagaagcataa          89810
ctctctttcttggatatattactattttccccacgttgtgtatgcttctcattaaaggtaggattctaaa         89880
ccatccaaatgaatctgtgccaccacctgcccctggactttggactgaagaggattgagaaatggtgaaa         89950
tacttaactatttgatagcttccttcattcccacagaccacatcagatgtagttagctaatataccaatt         90020
aacaaaattacccagcaaatgcaacatatatacttatttcattacttgtcaaaactttctaaatggcttt         90090
catctatttctaaaaagaatcccaaatgttccaggaacaatttcctaatgttctggttttgaatatcaca         90160
gctcatttatcagcgtatatcatagctatgactatagacgccaaaatattaagtaattcataatgacaat         90230
ttggacaatgaagggtatattagaacttctttgagtatttttattgcaatatgaattttttaaccaaaga         90300
cttgtatgagctccagagagcaaatccactacatttccccactctgcctcccaacccatcactatataga         90370
tccattgtggagcttttttacttctttgtggtgtattaaaacaaaggatataatatcccctgattatgga         90440
tgaaagtgatggaacatttactgccatgagagtcccttatgataagtggtagctgaactggaagtttaaa         90510
gaactgtggcagacaggatgggtaaatcaataggatccaggacctaggaatgcatcaggaaagacagca         90580
acagggaaggatgagctagagcaattgaaaggtgatacatatatttggagccaattcttttatgctat          90650
catcaagataaaaccagtattcctcacctggtagatatttctctttgcaaaggtggatattccacagttc         90720
acttccacagacctcatgcaaatgtcagattcagcggggagagggagcacccccagtttctttggcagcac        90790
agaatataatgcatcatgtttatttgcaagcctggagatattcttgcatacatattttatctagcagatg         90860
acactggatccaattaattggtggctttgaaatatatttattggaattcattattttgggttatagttgt         90930
ttctgtgatccatgcaatctaccaggatactcttcatgcttttgcatttaaaagaatgacaccaagggct         91000
tgtgaaaggcacattctggggtccatcccccacaattgtgttctgttgctttaggggaggtgtgagga         91070
tttgtgcatctacctgctttccacaaagtagggtccctgctggtataagggcacaccgtttaagtgctac         91140
tgcacagaagcatcagatgtcattaagatgtgtgttatctacatttcttattgttgctcaactgccagt         91210
tactcttttcataaaatatgtatctgtcctatataggggctaagaattaatttatcccagtctataactac         91280
agagagaagcctacttaatgagcattcttgatggggcataccacccataaatatggcaccttagcatttg         91350
aaaaaacagaagaagcaggaaagttctctctgaccttctccccatccttctcccctaaagccaggtcata         91420
agaccctcctatgagaggtgactctctataccaagaggaatagaacattcttatctctgaggacaaaagg         91490
acacagaggagaatctgaacacacaggccttgctaagttctccccaagttttttcccattagataataaac         91560
atttttacttcaatcatactttccaatgactgtccactctttatcaaacctaagtatctaagcacaaaaa         91630
tccacaggtttccctgtttctttgggtcttcattgccttatgaaggcctcctgtgtcatataaaactgtt         91700
attaaatgaagtgcactctttgcttaatctgtctttgtcatagggcctcagccatgaaactaagatag         91770
gaagaaaagatatttcttttccctatattattcaacaatattctagttatacatgtaagcttaaccaaa          91840
agcttctagaatatcaaagtaataagtgtgaaatatgtgtgcacacatgtgtgcatgcatatatat          91910
acacacactcattgtaggtctgtatatatatgtatatacatatacacatatatattttataagatgcgt          91980
atacacatatacattttgtatgtgtgtgtgtgtgacagagtcttgctctgttgtccaggctggactgca         92050
gtggcgctcactgcaacctccacctcctggttcaagtgattctcctgtctcagcctctggagtagctga         92120
gattacagccatgtgccaccatgcccggctaattttgtatttcttttagtagagatgggtttcacca         92190
tgttggccaggctggtctcgaactcctgacctcaggtgatccttcgcctcggcctcccaaagtgctggg         92260
attacagaggtgagccaccacgccaagccggcacataatacatcttgtaaaatatatttagcaaagtcta         92330
tttaaaaataattaatagtttattaaatcttatgtagattttttttcaaaatgaacaagcttctgtctt         92400
tccaacaaagctttggaaataataatcattgcattttcctctaacaggttaatcagcagatcaactaaaa         92470
ccaaaatgagtctttctctgggcacggtggtgcatgtctatagtcccagctactcaggagactgaggcag         92540
gaggatcacttgagcccaggagttcaagaccagcttggcaacaagatccactctaaaaaaa          92610
aactaaaaattaaaaaaaaaaaatagtctttctataactgtatgacagggctaaggtgatttttatttgac         92680
agaggaattaaatttcaatgtaccaagttctatccgtatgatatcttttctgatggttggaagggcacca         92750
aggggcttccatgaagctcagtgacagcattttcacatggaagtcactgcagcggaaagtagggtacaca         92820
ttcttggtaaataatatatgattgcactattgatgaatagcatttcaaaagctctgctatttattgtcta         92890
ttgaaagataaatgaatccagcaagtaaactgcctaaaatatttgtacactgttataaaatgtaaacacc         92960
tctatcatactataaatctccctccctccgctggaaaagacttcaagctgagatcatcctcgtcctcat         93030
cacatgattgcttggaatagagttgtccctgaggccacctgtcacctaagaggacttgtattcatttatt         93100
cagtgtccatgtaatgaaagaataagacagacatactgtgaatataagaacacagagttcaaaagactat         93170
tctgattgagcagaaggaagatactaaacaaatattagatgaacaaagcttgtgtgtatggctttggaag         93240
ataagcctaggatcttaatcttgtttatataacacaactattaaaccttcctgcgtaaaatacattttaa         93310
ttgagacttagcatgaagatagaacaccaagtctgggcattctgaaaagtttagacgcagaggaataact         93380
ggcaggcagtgatttaaagtggatacagatttttgccctggagttgcagatgcgtgtaggaatgaaaagg         93450
aagtaatgggtgtgataaccgatttaaacactaatcagtgagccccaaatattaaccatatactgggatt         93520
ctacaaagagatgccatggtaaaaatatgaattcaagtgttttaacctgtatagctggatacattcttgt         93590
gatattaacacggaaataagaaaaagacgagtttgatagaaaaagatgtttagctcaatatatgcac          93660
acactgagctttaggctcgaataagacatctgagtggtggaagacttagtcaagcatgggagaagttaga        93730
gctgaaacccaggtaaaatccttcaagttacaggcagaaatcattaccagatgtgtggtggagtcacacg         93800
ggggatgtgagtcctaatgcctttgcagatgcatggggaaggcagtgtcttttgaaggactggttttag         93870
cgctgcaagaagtaaagtaaattctcttttacttgcattcttgttccctcatggtgctttatgaggact         93940
aggcaagaatagtattgaaccacttataccatccatctgttagaagaacctataatacagaaatattgc         94010
tttgggctgaactccaaacgtaatacttaatgattctcttcaagtttgttgacacattctacatctcca         94080
catacaatttgctcccagtcgtttctgagatatgctacagaaagtacaattgatcaaacgttggctgtag         94150
ggattcaagaacagtcctgtgactgcattttcgttccttcctgaaactattccaaggccataaaacacct         94220
ttttgtgtgaactgtctttctgtatcccatttcagatgatatcttcttttcctttaaatacagtctttta         94290
tattttttctaattgtctgattgccaaaacaatatatctgcattgctataaatttacagtatcaaagatca         94360
```

FIGURE 8A-60

```
tacagaagaaaaatctttttttaacaaaagaaaaccattgttgataatttagtttacatacatacatatgt    94430
acatacatgtatcctcttagcactctgggcccggagtagagagcaaacctgtgaaacagatagatagat    94500
agatagatagatagatagatagatagatagatagaagatatagagatatgttagagctatagagatatag    94570
tctctagatagatagataagaatatctgtattctctctctcagacaaatgattaggaaacagtctataa    94640
gaacgtgtgtgtgtgtgtgtgtgtgtgtgtgtgtgtatgctctctagaggtagaatatatctctct      94710
gtagggagagagacttatgcatgtgtatgtatgtataaaacaaagaaacaataaaaaacacaaaggcccaa   94780
atatcaaccagaagaaactgaccagctgtaatgggacaattagaacatctgtaagaatatttgtactgga   94850
tttaaaatgataaagacataaaagttcatgtattcatcatgacacccagaataaaactcactggttatat   94920
tactaggccacgatcgcattttcctgaatcttgatcaataaaagaatcatgatttttttcccacttttcct   94990
atatatattgaatttcagagtaactaaaaaattggtgattacaagtaaaatttcagataatatatgcaga   95060
aagaacaatactatctgaaaatcattatttttgtgaaactccaaattaagtaagtatattaatctgtcctc   95130
acactgatctaaagaactgctggacactaggtaatttattaaggaaagaggtttacttgacttgcagttc   95200
cacatggctggggaggcctcaggaagcttacaattgtggcagaaagggcagcaaacgtgtcttcttcac    95270
atggtggtggcaggagagagaaatgagtgcccattgaaagggaaatcctttatgcttgataaaaccatcagatctt  95340
gtgaaaactgactcactaccacgagaacaccatggggaaactgccccatgattcaattatctccacct    95410
ggttcctcccacaacatgtggccatggaactacaattcaagatgggatttgggtgggacacagccaaacc  95480
atatcaataagagatctaggaaattatctctgattatttgaaaactgcgcaggtttatatatatatatat  95550
atatatatatatatatatatatatatatatatatgtgtgtatgtatatatatatatatatatatgtgt    95620
atgtatatatatatatatggtgggattcattaccaactgaatgtaattatcaaccactcttaagat      95690
aattaaaagtaacactagcaggtatcatgtaagtccttattaaattcagtataaagtacagagcagttcc   95760
tgggtgcgttgtttcctacaaagggcaccataaccctaaggaagaaaaacaagatgtgattaggaaacat   95830
tctgttaattctagaacatggggtgttcttcagcagtaatgttcaaaatgtggttcacaaagcagcaact   95900
tgttagaaatgcaaaatttaagatcctatacctgggaggaggcttcctgaatctaaaattgagggtgtgg   95970
gttgcaaactattatttctttcccaaacccatctgtgatgtttatgcttgataaaattgatgggacggt    96040
tcattgatttccataaggaattaacgatgtaagaaaatgagaagaagaattgtattatggaaaagagggt   96110
gtcaatattttcacttgctttctctttaaatgtgtggatcacaagatttgcttttcattaaaagtattca   96180
gatatatatacgtatttgaaatacatgtgcctatacactaaccccaaaacagctcattaagaatctcttc   96250
cactgggacataggcatcagtatttgttaaaatatcactaagtgtttagtgtggttgatgagtgtagaaa   96320
gaatatatttcaccaagcttatgagatgggcagtttggggccaggagaagcaggcagtgaaagaacttg   96390
ggtgataagcagctgtctacttgcaaaacaacttattattaatgaattgggactttaaattttttttttt   96460
attttcataggttttaggggaacaagtggtatttgcttacatgagtcacttcttagtggtgatttgtga    96530
gattttggtgcacccattacccaagcagtatacactgaacccaatttgtagtattttatccccaacccc    96600
ctcccacccttccctctgagtccccagagtccattgtgtcattcttatgcctttgcatcctcatagctc    96670
agctcccacttatgaatgagaacataagatgtttggttttccattcctgagttacttccttccaataat    96740
agtctccagtcccatccaggtagctgtgaatgccattaattcatttctttgtatggctgagtagcattcc   96810
atcatatatttatgtaccacagttcttatcgctcgttgattgatgggcattgggtggttccacatt       96880
gtgacccaatgcttttaaaataatgtgtgtgtttggccacgaacataagccagaacactagaaaaattgt   96950
ttactgaaagccatcttagtttcaggaacacaaaggaaatgaggtaatgtgtgaaaagaacttttaaaaat  97020
tgtaaggcattttgcataaagatgttaggtgcttttttgaagtttctattttaaatgtggtcaattagagag  97090
gttttttttttttttcattttatgtttgccttgaaagcatttagaagtatgagaatatataatttcattttg  97160
taaaacacaatatgttgaacctaataggatctttcttggaaactgaacattgtcctgggttttggaggca   97230
tcccattgaaatttagccatgattccatattcagcaaattgctgtggacccagatacatcttcgctgacc   97300
agaagtcttccagagtggaagatttttagtaaattgcaatcttgtagaattagataaaatgcat        97370
tctgtttccatccacttgccgatatcccccactgctaattaaaggaaacaatccacaattgatttac     97440
ttatgtaaatgtagattacaaaccaacaacatgattttaagagtcttaagaagttgagggctatttgaa    97510
tgtttactcttggagacatgtatatttaggtgtcctggtcaacaagatcaattgtaggaatggttggtgc   97580
aatcacattggtcattaaatacagacatcacacataatcaagcagatttagctcagggtatgggtaactc   97650
aacatatgaacaccattcaaagtatttcccaaaaggctggcatggtgacatggttttggttgtgtc      97720
cccacccaaatctcgtcttgaattcttgtgagagggacccagcgggaggcaagtgaatcatgcggcagg   97790
cccttcctgtgctgttctcatgatagtgaataagtctcatgagatctgatggttttaaaaaggcgagttt   97860
ccctgcataagctctcttctgttgtctgctgccatgtgagacatgccttttaccttccaccatgattgtg   97930
aggcctcccaggcacgtggaactgttaagtccattaaacctgtttcttttgtaaattgcccagtctcag    98000
gcatgtctctatgcagcagtgtgaaaatggactgatatagtggcttacgcctgtaatcctagcactttggg   98070
agggcaaggcaggcagatcgcttgagctttgcagtttgagaccagcctgggcaacatggtgaaacctgt    98140
ctctataaaaaatacaaaaattagctgggtgcagtggcacaagtgtgtattcccagctacttggggacac   98210
tgggtcaggaggattgcttgagcacaggattgcttgagctagagatgcccaatccatctcaagggtgcag   98280
tgagccgacatggcgccacttcagcctgggtgacaaagtgagatcctgtctcaaaaataaaaaaatatt    98350
tccccaatggggacatatggcttaatagttagggttattgtttgtagtgatgaataggttttggaaatagg  98420
tcagtggtgataattataccacattgtgaatgtaatgaaacaacaagaattgtacatttttaaaatgatca   98490
aaatggcagggtgatcccacacacaaagggggggggatagatatacatagatatcttcatatggttttttc  98560
ttgttttttaatttttttattttttattttatgtatttatttatttgagacagagtctcgctctgtcgcc   98630
caagctggagtgcagtggcatgatcacggctcactgcaacctccacctcacaggttcaagcgattctcct    98700
gcctcaacctcccaagtagccagaaatacaggcacgtgccaccacgcccagctgattttgtattttttt    98770
tagtagggacggagtttcaccatgttagccaggctggtctcgaactcttggcttccactaagaggttcta   98840
gtaaagtacatactggctggattcaataaagcacaaataggcagcaaatgcttcttacatctcaatctaa   98910
tcggtagccttctttatcctcacccttggctgactaacgtgcataaagcataggaattctggccactcaa   98980
ggatcttaaccatccagttcagtctgttgcaatttctcgtcacattacaaatttttttcactttcctttc  99050
cggagaaagccatgatgaactactgcagtcgaactcgatctc                              99092
```

>HNL4 Exon4 (3437-3622) Exon5 (8810-9599)

```
aaacagtcttattatttcaaatgctaacttcatggctcatagattctgtatcagtaagcccacatgcttt      70
taagtctgatttatagaaaacatgatttgccctcaaacaatgtaacctcccaacagattcatcttacca      140
ctacacagatagagctgattagtcaagacagaagaattgcaatagataaagggtttaattcctgcagagc     210
tggctaaatgggagactggagttttattgttactcaaatcagccttcccaaaaatttggaggcttgggtt     280
tttccagaatactttggcagacaggggctagggaatgagtgctgctgattggttgaggatgcaatgatag    350
gggtgtggaaaacagccctggtgcacccagtcggcctctatgtggggacacagaggagtcactggtccta    420
gtaggaccaatcagttgtcagaaatgcaaaagcctcaaaagacatcttaaaaggccaatctgtactatgc    490
ttattacctgggtaatgagataacctgtacatcaaaccctgtgacatgcagttcacctacataataaac     560
ctacaggtatacccctgaacctaaaataaaagtcttaaaaaggcaaattttagcttctagtgattgggga    630
agttgcaaatcttgtgacctctggaataatggctggtaatcattcaactaagcttacatcttagcagaat    700
tcaggcctctctcattctttaacctggtggcctttcattacttttacaaaggtggtttagttttaagagg    770
ggctattatcatttaaactacaagttcaatttctcccaaagttagcttggcccgtgcccaggaatgatca    840
agaacagtgtggaggttaaaggcaagatggagttggttaggtcagatctctttcactgtcataattgtct    910
gactattgtaagttttgcaaaggtggtttcaaggtgaaaggactatactcttaaagagcataaaattatt    980
gcattcattgtgtacctgaaacaggcactcccccttgttgatagtttaaaaagaaaaaaataataatccc    1050
tggatgttgcaataaatgaaaatgccatggcagaaactgtgaaacaccagcctcaaaacaccacattga    1120
ttcgttaaacttcagagatccatggattgtcgtttccctcagccagcctgtaggatatttggaagaattt    1190
cagaacctcaaagatcaaaccatccaataggatgctgttagaagaactaagatttttgaaggcaggggat    1260
attcattagcctgcttttggaaaggttaaaacactctgattttgctagggaggaagagtttatggtggaa    1330
gaaaggccaatgatttcctgcgtgttgaaaatcttcatactcctccacagaaacaaaataagtcaacaag    1400
tcattctgcagaattgagaaagagagaacagtgagtgaagaaaagacgtgctgaagacagaatcgttctg    1470
ttagaaaattgctcgtgccttaggaattaatcacctctttctttaataggggaagaaagcattgccctgt    1540
ggtattataggcacctaaactgacatgattcgtcattgtcatataaggatcttcgatcttttctcccaa     1610
gcaaagcctgatgccttttatgaacgatcgtgtcaaagatatagtgatggagacaggtgttgcagaacat    1680
ttttggcatgaagcactaattagtaattgctaattaaatgggggaggaggcttgggtaatgtctgatcgc    1750
acccactaatcgtagctaatctcccgtcacatccctctgaacttaaagaagatcacattggtaggatgt    1820
gtcttaagtatccaacctcgcagttgcgacgctgcctctctttgaagctgcaggagatagtgactcccga    1890
ttcaggcttggagttttattgtcattgttgaacgaaaatcgtcctgtgacttctctttggagccaggcca    1960
tttcctccttccagctcagagcattttccacaggtgtcaggaaagctcatggaagaaatgctggttg      2030
actcaattggtatgcagcctcatcctctactcttttgttttaaaagtagaagccggcactcagtcactc    2100
cttggaatgccgtcaactttggttagggacgtgctttgagggaattggtttgatgttatttagggctta    2170
aagcagcctgtcttcatacaaacatgactgcaggtggccataataatgtgctgagcatccttgaaatga    2240
gtgaatgacatggctcttggaaaaagaaattgtatagaaggggcaaatatcatagttgggtagttgggg    2310
aaggctcaaataaggacgtgaaaatggttaaaaaaaaaacttttaaaaattcttttgtcttttggaagg    2380
catatccagtacagatttggacataaagttggattaaagtttatgcaatgaactaaacttgcaggaggcc    2450
ttagaaaatattcctagttttgaatctgagtaggagagtgtatgtcttcccaaacttgacttcaaaacat    2520
cagaagaaagcagtttttccaggtcaagctattttttcaatacagaaggaacaaaaaataaaatagattaa    2590
ctcataactttgctatcattaataccaaaattgccattttcaactactaaggagaaattaagaatcgta   2660
tgccttgagtaaaatctagatcctcaactcacagatccttctttttaaaataaggaaggccagttcctg    2730
atattttgggaacagttggggagatgtgaatattcattagctttgggtgaggttcaataattacatttt    2800
tttgtatgtgactaatattttcgctatgtaggaaaatagaggtgtatactatttacgagtcggatctagt    2870
ggagtctgtaacttacgttgtttcttaagcattgaaaggagttaaaacaaaatgttaataactaattcag    2940
tgagaaagacaggcgcacactgcctttgtatacatgcacatattcttagacacagacacacatgtgcact    3010
tacgcccccctcccccccccacacacacgtactgtttccctgaaaaattcttgtaggagtctgttgcattt    3080
ttcaaaaagaaaatgaaaatgtgcacagaaatgatacctttgaacctagtaaaatttacgacgtcttctg    3150
ggattgcttcatgttattaatattttagattcattttgccttctctattagccacatatatacacaaga    3220
tgccatggtatcataacatcaacctaaaataaccattatttataattattctgccacaaaatttttt       3290
ctcctgttcttcctctaattggtgggggtgagagttgaggagagagagaatgaagaagacaagctatgag    3360
atatcttttcaaatagcagagacacgtatgcacttttttgccaccaaaaatatcttgtgttctt         3430
ttgtagGGTTTTTAAGTACCGGTGACCAGGCAGCAAAAGGCAACTATGGGTCCTGGATCAGATTCAAGC    3500
ACTGCGGTGGATTGAGGAGAATGTGGGAGCCTTTGGCGGGGACCCCAAGAGAGTGACCATCTTTGGCTCG    3570
GGGGCTGGGGCCTCCTGTGTCAGCCTGTTGACCCTGTCCCACTACTCAGAAGgtaataatggcaccccca    3640
gggtgggcgggcaaatacccctgaaccaagaaatgaatggtcagagctcatatctcagatgcatgtcctgg   3710
ttaccagaagtcactctggcaacagaaatgcccaaaagatcaaatgaatccatcttcatgtcttttaac    3780
tcagcttttgttccattttgctctgtcacccaggctggagtgcagtggtgatgatcatagctcattgtagct   3850
tccaactcctgggcttaaggcttctcccatctcagtctcctgaatacctgggactactggctgcttttta    3920
aaattttttatagagaagtggtcttgctatgtttgcctgggctggtctcaaactccaggactcaagcgat    3990
cctcctgccttggcctctcaaagtgctgggatgacagatgtgagccaccatgcttgatcagtaatatttt    4060
tctcctaatttaaatgtgtgacaattaggtgttggttacaatgattggaacaaaataactactttagaag    4130
tcctgacactttgttttttttttgccattctgactgtatttgacactatttattaacttctag           4200
tacaacttagtaaaagtagtatggaagagagacagtatgtcgataagggatgcgggtgtatagatttgt    4270
aaccatcagggcttttagccacatgttttttaagaagtcgctcctctctctaattcatattaattcttta    4340
aatcttctgaaatattgaaacacgtctggtgcattcatttagaagtagattctgggtagaagtagattc    4410
tacccagaggaatagtgtctctctccctgatggtctcctcccctcccttgctcttccctccattcttc     4480
tcttttccctctctcgtcctgtctctctctccctctctatgtcctctccctctacctctctcctgctc    4550
cctctctctctttgctctgtctctcacccctctctcccctcctccactgtctctcctccctccctc     4620
tctctctcccctcacactgtcccccactctccctgtctttctccctctctctcttcctctctctcc    4690
ttttctctgtctccccactctcttactcactatctcctttcctctctctctttccccccttccctctgt    4760
ccctctctctctttgtttctttctctctctccctccctttcttcttcctgcaaatatgactttcac     4830
caaaaggacctccttcctggtcaggtcagcatgcagcactagggagtgtccagagtttgcttcccctctc    4900
cctcctctctctctctcctgcaaatatgactttcacgaaggacctccttgctgggccagtcagcacgag    4970
gtcctctgcttgtccccgtgggagctccaaaccctccctgggccctgctattaacctggaaaagctga    5040
```

FIGURE 8A-62

```
tgttggcaaagtggagaaagaggaaaccacaaaaacacatgtgcatcatgttacctcaaccagatgtgca      5110
cttgaacgtgtagtcagcataggcaccgtacccaaccagatgtgcacttggacgcctaagcagtagatg      5180
gttatgctgcctaagtaatggtcagcataggcagccacaccctgagccctgctggagtgcctgaggctt      5250
tccccggaggctcactcagtggattcccagctgtccctttgtgaaggaggctccctgcagtatccgatga      5320
cagacttcaaagaggagtccacaggaatttgaggcaattggttctggaagcaggatcacaaattcctggc      5390
tgtggcctaaaaggaagaggcaggaaaatctgcagtgcagatccagccctgggttgcctggccacacgca      5460
agtgaatattcctaatagccgtctcagtcatcaagacagctttgtaatttgttctgtgttgtcagtggtc      5530
ttcagaatggcaccacactgactgaacctgaagttctcaaaaccttcatggaattttttttttttttcag      5600
ggagtctcactctgtctcccaggcaggagtgcagtggcacaatcttggcttaccgcaacatccaccttct      5670
ggattcaaagcgattctcctgcctcagcctcccgagttgctgggattacaggcgcccaccactgtgcccg      5740
gctaatttttgtattttagtagagatgggctttcaccgtgttggccaggctagtctcgaacttcctgac      5810
ctcaagtggcccacccacctcgacctcccgaatgattattttttaaagttatcagctggatatggtggctc     5880
atggctgttatcccagcactttgggaggctgagcgggaggatggcttgagcccaggagtttgagaccag      5950
cctggtcaacatagcgagacccgtttgtacaaaaatgaaaataaaaaccagctgggcctggtggcgcat      6020
gcttgtggtcccagttacttgggggagctgaggtgggaggatcgcttgagccaggagtgtcgaggctgcag     6090
tgagctgtgaggttccactccagcctgggtgacagagtgagaccctgtctcaacatacacatacatacac     6160
ataaaattaaaaagtatctttctttagagtaactgcaggactttcttcacttcggcaccgtctggacaag      6230
tttctggatcgctgtgctcctcagtgtcttcattggcaagataggacagatgagggtttcctgaaatcct      6300
ccaaactctgaattccttgagttttttagttcataatgtttttgcccatgagaccaaatgccctttgatttc      6370
ttactagtgctaatgagaggaaaggctcatatttgtattaactttattttcaaaaacacgataagtgaaga      6440
atctgatgaaccatttggtagagagatttctatggcatttttgaaaatacctcgattttcactttttctca      6510
attgatataatcacaattgtagatttagaaagcagtcagaaccaacttcaggagtaatcaaacacatgta      6580
agccacattaattggaggcacgtgttaattatttaagtcaataggttggaaattattatacttttgcatc      6650
ggtcatttctgcaaggcatgcttctaaacagcccatcaatataatcacgaattatgaaaaatacaagcca      6720
ggcactgaggctcctgcctgtctatcatcccagcaatttgggaggccaaggtgggcagattgcttgagtc      6790
caggagttcaagacaagcctgaacaacatggcgaaaccccgtctctacaaaaaagagacgcatctgttgt      6860
cccagctacttggaggctgaggtggaaggatcatttgagcctggaaggcagaggctccagcgagccaag      6930
atcccgccactgcactccagcctgggtagcagagtgatacctgtctaaaataaaaataaatatagccag      7000
actgtttgcttaggaattccttgcctggttatatgtcatcttgggcaatcctccagtctttaaaatc      7070
acgtcttcctgatgacagttatattttcctcatatttgattgcttctgtgacctaaaaatcgacaggc      7140
agttttatgaagatgttcaccacagtattagtatcgtagcaaagaatgaaatgaaaagctacaagatcaa      7210
aaggagaggaaaattataatgaaccatatgtatttactcaataataatttaagaatttacctaagatata      7280
catcagctggaaaaacagtttagacagctatataaatattgggctcagctatgcaaaacagacatttgaa      7350
tggagggaaagagctaagaattatgtgaactcctagcatactcattacgctaaggtgagttgtgtttaaa      7420
gtatgaattctgggtgatttttttcattatccaactattttagtcttatcaggagttctcgttacttccct      7490
aacatacaaataaatgttttatgtatgttacttttatatacactactgcctaaattattgccagtacttat      7560
gagaagggcgggaaaggaacttctcacagcatttttttccaattctgaatgttttaactaatgaaagtatc      7630
caatagaatacatattgactttctctcttggtttttttttttttggacattttaaaataatcttcagagc      7700
caagcactcaagtcaatacttgcacatttctgacagaaacgttcccaggatggctttgatgacatactgg      7770
tcaaagccatattggtttcaagttgcgtcctgtgtcttggcatctccagtcttttaaaatc      7840
acgtcttcctgatgacagttatattttcctcatatttgattgcttctgtgacctaaaaatcgacaggc      7910
atgaacttctggactcacaactgaatgcctattcttagtgccgactcgggctggattcacggaaat      7980
ggcaggaagcaagtgtaaatgcaatgctgattttacagcgcacctctcttgtcctatcgtagttaaaaa      7980
tacagatttatacttctggacatccgtgtagtagactgaactcatggagaattttaagctacacagaat      8050
tttactcctaaaattgcccatgcttttttcaagtttctcagcaagtggagcattttttatatgtggcaaaat      8120
aaaatatacacatctctgagtttccaatggatgtagttttgaaagaagtgacctaaaaaaatactccttac      8190
ttgggcacccagttgaggatttctttaagcatagctagctgaatgtatttatttttaattgcaaatctta      8260
atatcttcattagactcaaggtagaagtagaaatgcgctcctgaattagcactctgaagttgattcaagt      8330
ggatttcttttttttcccataatgaagagatacctagttttgcttgtgagacaagagggcctttgaactgg      8400
tactagcttaaagcattttttttcttggaaatggggaatgcagttgctcttggagtttttatatatggca      8470
tctggaggcaaggaagcaaaaacgacactaaattgtggaaggaaaaagaaatcacatgtatttttaccagt      8540
gcaggagaagtgtcaatgtggtttcatttccttaaactcgtgtgtgtgtgtgtgtgtagaataacatt      8610
ccctaaaatgaatgttcaggaggaggggtgaaggggggaatggaaatgaaaatgggtaaaagggcccctga      8680
cagagctgaatgctactacatccagaaactcacatgcctgagagacaatcacagccttcattgctcagta      8750
aaagctgcatttctgtcctgtcctgcatttgcatgtccacaattttgcacctgcagGTCTCTTCCAG      8820
AAGGCCATCATTCAGAGCGGCACCGCCCTGTCCAGCTGGGCAGTGAACTACCAGCCGGCCAAGTACACTC      8890
GGATATTGGCAGACAAGGTCGGCTGCAACATGCTGGACACCACGGACATGGTAGAATGCCTGCGGAACAA      8960
GAACTACAAGGAGCTCATCCAGCAGACCATCACCCCGGCCACCTACCACATAGCCTTCGGGCCGGTGATC      9030
GACGGCGACGTCATCCCAGACGACCCCCAGATCCTGATGGAGCAAGGCGAGTTCCTCAACTACGACATCA      9100
TGCTGGGCGTCAACCAAGGGCAAGGCCTGAAGTTCGTGGACGGCATCGTGGATAACGAGGACGGTGTGAC      9170
GCCCAACGACTTTGACTTCTCCGTGTCCAACTTCGTGGACAACCTTTACGGCTACCCTGAAGGGAAAGAC      9240
ACTTTGCGGGAGACTATCAAGTTCATGTACACAGACTGGGCCGATAAGGAAAACCCGGAGACGCGGCGGA      9310
AAACCCTGGTGGCTCTCTTTACTGACCACCAGTGGGTGGCCCCCGCCGTGGCCACCGCCGACCTGCACGC      9380
GCAGTACGGCTCCCCCACCTACTTCTATGCCTTCTATCATCGCTGCCAAAGCGAAATGAAGCCCAGCTGG      9450
GCAGATTCGGCCCATGGTGATGAGGTCCCCTATGTCTTCGGCATCCCCATGATCGGTCCCACCGAGCTCT      9520
TCAGTTGTAACTTTTCCAAGAACGACGTCATGCTCAGCGCCGTGGTCATGACCTACTGGACGAACTTCGC      9590
CAAAACTGGtacgttcatcttcgtgttggggtatcactatccttgccacttgtttgtgtcctcaatata      9660
ggtgttgcttctactgccacgtgcaggagcacacacgcatacacacacatacacatgcatgcacacacat      9730
acacacagacacgcttacacacacagcataacaggcagcttctccccccaacatctatggcaactcat      9800
tttttctttactcctaaagtgttataggagtaaaacacttaactgtcaaaccagattttttactagagtt      9870
ctaattgcccattgggaattccagagttcctacctgcaggtgcaggactcatacatatatgatggttctg      9940
ttaacagctgattaaacggttttgttttttgtccttgttgttttagagacacagtctcactctgttcccca      10010
cactggagtgcagtggtgcaacagtagctcactacagcctccttgaactcctaggctcaagccatcctcc      10080
tgcctcagcctcctgagtagctgggactacaggtgcctgccaccatgcctggctaattttttaatttttttt      10150
```

FIGURE 8A-63

```
tttttggtagaaagagggtctcactctgttgcctaggctggagtatagtggcgcaatcatagctcactga      10220
agcctcgagctcatgggttcatgtgatcctccatctcagcctcttgagtagctgggactacaggcgtgc      10290
accaccatgcccttacatggatttttgtagacacaggggtttgctatgttgcccaggctttctctcaaactc   10360
ctgggctcaagggatcctcccacatcagccttctgaatagctgggactacaggtgcacaccaccttactc    10430
agctaatttattttgttagagacaggggttttgctgtgtcacccgagctggtctcaaactcttgggctca     10500
agtgatcttcccacctcagcctccaaaagtgctgagattacaggtgtgagccatcacaccagccctcatt     10570
acagagttttaagtctaatttcaaccatatctctttgttaatttgcaaggatatcacagcacatgtacc     10640
acttggggaactgtgttgattgcctggccataggaatgaaaaatcataataattataaagaaata         10710
taaatatatattcctatatatatatttaatgtctatataaaaaatatagatattcctatttgtataatatagt  10780
acatttatatttgtatttgtatatatatacacacaaatatatttgtatatacaaatacaaatatatatac     10850
aaatactatatatatacaatatatatacaaatacaaatatatatatacacaaatacgtttgtattttctc    10920
tgctatataaataactagagagagaaaatgaaaatatatgatatttgtatcatattgctatatgtcatgc     10990
atacataaacacacacacacaaacacacatacatgtgtatctcacaggaaagtcatttattggcctaaa     11060
tatgtagaaaatataaaatatacaaaaagcatatatacaaggatctgccaatattctgctgagcgga      11130
ttctctgcaaaccatgggagaaaagaacccaaaacaacctaaatagctccaaacattgtggcatttttc     11200
attttctcttgtctaataatgtaactgtggaaatggatggggtgtcattctgttctaccagtgtgtgcct     11270
ccatcatcaccctgagcctctttacactgaatgagagagaaagatgtgcctgtcgcccagggagggtaaa    11340
tcttcccgtgcggaatgaggctctgagactgcagtggccctgccacacatgagttatgcacagtaatcct    11410
tagaagatctggggatgctggtggtttcaatgcctacgtgtttagcagctggcatactgtacaaagattc    11480
caaagtggtttgggtagggagtggtttgagaatgttttgtgcccttggcgaaagtacagcatgttttgg     11550
agtggaaaaggtatcacctggataccacctttcaataatcagactttgtagatttggtctgagaaaggct    11620
acccagaggagaagagaggagggacccacatttgatgcaaatgcttgtctatcactcaacggttcttttt     11690
tgtgtgaagaaatgattgaaatcaaattaatacttttttttaaagtaaaccttgttttattagtttgttggg  11760
actgctgttatcagagtatccaaaactgtatggctatgctgggcggtggctcatgcctgtaacccag      11830
cactttgggaggccgaggcaggaggatcacttgagctcaggaggtcaaggctgcagtgggccatgtttg    11900
ccaccactgcactccaacctgggtgacagaccgaaacctttatctttaaaaaaaaaaaaaataaaaaaa    12110
aaaaagcaccaaaaacggtgtgtcttataacaacagaaatgtatcggttcacgctttctaaggccagaag    12180
ttgcaaatgaaggtgcttgcagggccaagttccctccaaatctgtaggggagggtatttccttgctcct    12250
tcttagttactggtgtttgggtgcagtctttggcattcctaccttgcaggtgcaccatcccactctgtgt   12320
ctttgtcatcttacggcctccctgtgtgtctctgtctccacatggccgtcttcatataagagcatctgcc    12390
aaggtgcattagaagctcaccctactctagtatgacctcaacttaacataaatagtcatatctgcagtta    12460
ccctatttccaaataagctcacatactgagatactggggttatgacttcagcgtatcttaatttatgggg    12530
agacagtattcaatctctaatacctgtgaaatcagggccaggccctcttttgtgacagcactgagatag    12600
gcggtgtctgcccttgcagagaatttcatcctcttgaagcctaaagacttccatgagagtttcccaacat    12670
ggctatactcattcaatcttcgctacattggcatccaaacgtattaccgacttggtctgcaaacactctc    12740
tttacttactctcattaaaaacatatgcttttctttttcctccttacatgatttgaaaataaactttata    12810
tgattatcttaagtggaaagctagaatcattcctcatcattttatggaaccattaaaacaatagtgaaa    12880
tctaaataatgctgttaaattctcattagctcttcctgacttccaaaggctatgagactgaggctggctc    12950
tctcattattaaaaaaaaataccccaaaaaaaaaagaaaaagacagaaaaagataaaggaagttaatt    13020
agttccatgaggtgatcgttatcactgctgacaccaaatggacgcttttaccaagacatcacgaaggtct    13090
gagagagccgtgagaagagaataccacaatgatctctctgttattgagtgcttttaatgccatgaatctg    13160
tttcttaaaatcacttggcttagagcctgtgatttccaccctgcatttagggaatacattcacgttgcca    13230
ttcatggtctgtgttgagggtgcttctagctttcatgaaggccctgacatggctggaagagatgaggaag    13300
gaataactgctagaacttggagagacgctctgatgctactgaaatcaaaagctgcaggtagagagagttc    13370
attgaggtacccagagctcgaatgtcagtccgtctgaagcctctatttttgtttcttccgcccatgggaa    13440
acatccctgaaataacactgagtgtattaatgcagtgagctcttttaattcattggaaagtattagaat    13510
gactcaaatgattcctcaaggaagttactcagaacttacatctcatgtgaaatgcaacgtgtggattcaa    13580
atacaaatagtttaagtgatcacacctccatggcagccccataaaagaaggaaatgggaatttcactgt    13650
cgggcacagtctggtgagctaggtattcgtcagtggatgacaaggacttcagttgcagttggtagttatt    13720
tgtttattgtaaattgggtggtggcccgatcactccagggcagagaaggattccctggtcaccaggtgca    13790
gagaatgaaccaaactgatgcccgcaaggagaaagtatgggatggcacctttatctgctgtcatggtgtgag   13860
ctgccaagtttaacgccattttgcagagcacactcagatgatgactcacagaacaggagggcatattt    13930
ctgcataccatcactgttcccttccagcactggaggtgacaggaggaaacaagaatagctcccagcgtgt    14000
ctgtcactacacggtgccgtggagaaaggatcgcattgtgccaggacatacttcaccactctcagtgggc    14070
gttaagtcaagcgttctaaacctgcaggcacagccagtctctcgatggcgcatgtgtttgccaagatgaa    14140
gtggatgggtctggatgcttctatatagacatctcaaagtagatggttctgacctttagtctaggttttg    14210
aaggcacatatacctgtatacataaacctttggttttgggatgagcacagaaaatgatgttgggatgt     14280
gcatggcggagaaaaggaaggaaggagggaggaatggaggaaagagagttcagacaaaggaacgaaggg    14350
agggaaggagggagggagggaggaatttattaggagggcgggagggaatcaagaaaggagtaaaggaagg    14420
gaggaagggaggaaagaagaggtaagggggggaggagaggaaggaacgaataccgtcccgccccccgc    14490
gccgcacgagcccaacaccgtcactattcactaccttcctctctcccgcctcctactatacaccaa      14560
acgcacgtagaacccaaaactctcacagacgagtcaggaccatccattcatggtgaatcgatcaaataaag    14630
tcgccacgcccatatccttataatcccatcccttaccaacctcaccctttctctgtccctccaactcatt    14700
ctgcctctctcacgtatctctgctcttcttccgataaacccgccgcttcgaaatgcgttcgcgtctcat    14769
```

>HNL4 Exon6 (2746-6134)

```
acctcactgtctctggagggtttgtaagggcagaatgacttgggctatcataatctccacaaagtttatctg    70
gctttaagaattctggctgtgcatctccgagatctttaatagacagacggtatcaggtggcagctcattt     140
atatggatttcccaaatcctctgctttattcttcaagaacaaaatataatgtgttttctttacctgtcaa    210
```

FIGURE 8A-64

```
atatacoctgagttccttcgaaaatagccttgtacccaacatgaacagaatactccttttcctagatgct    280
cactgcttaatagatgaggtagccacacatctaatagatccaattcagtaaaattggatccatggaaaaa    350
aaggtagaatcttcacttccatttgtttcttagaatattaaaaatcaataactaatattagtggatttt    420
tttcctaaaatattcattcacttattttctttcagtacacgttaaataactgaaaattttaaaattatt    490
tcagaggacttaaagagcaaaagaaacatgagttgctgcattgaatccaacatttttcaaaaccatgta    560
agaatacatgcataataaataaaaaaagcagaagacttttcaaatatattgttatcagtaaataagaaa    630
actcatggtattagaacctatgagattatatatatttgttctcaccctattagtaaagtgaaaacacagc    700
agttagtgtgcattcaactaaagggtagaggtcaactttcttttctcctgtattatgttatacatctaa    770
tatctatatctatagatagatatacacatacacatatatacacatgacatacatatatatactgcatata    840
gtatatagttagtatgcagtataaactgtggtatgcagtatacttgtatatagtatgtaatatacaatat    910
actttatgcactctacaatgtatacaatatagaaattcagtatgtactctgatatacagtatatcactc    980
cctacttctcccttcccttgcaatattataggtgttctattttttatattggaagagaggggggtaatattt    1050
cctgaattcttaccatatgccagacatcttgtcattatctttcaaccttcatcacttacctccaaccctg    1120
atattttcatcagccatgtagaggagtaagttaaggccaatactggctggaaaacttgcttaagatttca    1190
cagctcttaactagccagagctgcagaaagttgaatacagggaaatgatttattttatcaccaccacaga    1260
ctcagactgagggggataaaatcttccttcagcaagtgtggcgcctctggctcaagtatattgtttgaatc    1330
ctgcacagtgtctggtaatggctacagatacatgatcttccttggtcctgcagccttctgccatgcagc    1400
catgcaatgactggaggcagttcacagaagtcccgccaaggagaagttacctggaagatagcccttagc    1470
tcacacctggagccattgatcaggatgttgcaactccctgcttgcctggttctgcacatcacatctcaat    1540
gctcagtgctaactagtacataacatttgccatgcataatctcaaatcgtttttataacaaataaacct    1610
taagacgtaattgttttttagcttactttacaagccataaaaaaaatggaagaaatgagcatttggtaat    1680
ttattttttgaagggggaagtgttatcctaaaagagtcagttgcaaagatgtttattaaaggccctatgtt    1750
ttatgaattatctccaaattttttatgattctccttctacctgtgaccacttgtgcaaataataagaagat    1820
aattctttggctcatagtttccaagcacaacttagcatctgtaacagcccttgacttgtttctgggtgtc    1890
ttttttatcttaaacatgttaacctcatcataactatatgtaccatttttagcaaacttcttacagctaac    1960
atagcgtgctttcatcttttttaccttcaaatagagagcaaacatggtgcatatgtctatttacaaaca    2030
ctttgtaattataaagcctatttttatttctactgttaatatcaattttcattgctaaaactgcaacatt    2100
tattcatttacttcaaaagcaattcttgagcaagaaagagaatacccatttcttggacaatagcttctta    2170
atcagaatttctcaacctcagtactgttaacatttgggtccagataacttcttgtctgtgggggtctctc    2240
ctgtgcaccagagggtatttagtagcatccctcacctccacccttcatagaacaaccttcgtctacgga    2310
aaccaaaagtgtctccagatactgccaaatatccttggcaaatcagtcctggatgagttttacagt    2380
tcgacaagagtgaaacttgaaatactgaaatttttcctagagacacttagttttccttcttttccctttat    2450
ttttgaagatcatttgatgccttaaaaaatagtaaacatgttataaaaattgcataatgctgctatcagg    2520
atttatattttaaaagaaaataagagcaatttttaaaggaaaagacaacatggtagacaggtctaggatt    2590
aaagcagaatgtacctttgctgcttgggtatttgtgctcattgataaatatatatgaagagcagattgt    2660
aacttcctgatttattggtttaagataatttcacgtcacatgttggagaagtatgaccttctttttttct    2730
tccttctatcctcagTGATCCAAATCAACCAGTTCCTCAGGATACCAAGTTCATTCACACAAAACCCAAC    2800
CGCTTTGAAGAAGTGGCCTGGTCCAAGTATAATCCCAAAGACCAGCTCTATCTGCATATTGGCTTGAAAC    2870
CCAGAGTGAGAGATCACTACCGGGCAACGAAAGTGGCTTTCTGGTTGGAACTCGTTCCTCATTTGCACAA    2940
CTTGAACGAGATATTCCAGTATGTTTCAACAACCACAAAGGTTCCTCCACCAGACATGACATCATTTCCC    3010
TATGGCACCCGGCGATCTCCCGCCAAGATATGGCCAACCACCAAACGCCCAGCAATCACTCCTGCCAACA    3080
ATCCCAAACACTCTAAGGACCCTCACAAAACAGGGCCTCGAGGACACAACTGTCCTCATTGAAACCAAACG    3150
AGATTATTCCACCGAATTAAGTGTCACCATTGCCGTCGGGGCGTCGCTCCTCTTCCTCAACATCTTAGCT    3220
TTTGCGGCGCTGTACTACAAAAAGGACAAGAGGCGCCATGAGACTCACAGGCGCCCCAGTCCCCAGAGAA    3290
ACACCACAAATGATATCGCTCACATCCAGAACGAAGACATCATGTCTCTGCAGATGAAGCAGCTGGAACA    3360
CGATCACCAGTGTGAGTCGCTGCAGGCACACGACACACGTGAGGCTCACCTGCCCGCCAGACTACACCCTC    3430
ACGCTGCGCCGGTCGCCAGATGACATCCCACTTATGACGCCAAACACCATCACCATGATTCCAAACACAC    3500
TGACGGGGATGCAGCCTTTGCACACTTTTAACACCTTCAGTGGAGGACAAAACACTACAAATTTACCCCA    3570
CGGACATTCCACCACTAGAGTATAGctttgccctattccctctcctatccctctgccctacccgctcagc    3640
aacatagaagagggaaggaaagagagaaggaaagagagagaggaaagagagaaagtctccagaccaggaatgttt    3710
ttgtcccactgacttaagacaaaaatgcaaaaaggcagtcatcccatcccggcagaccttatcgttggt    3780
gttttccagtattacaagatcaacttctgaccctgtgaaatgtgagaagtacacatttctgttaaaataa    3850
ctgctttaagatctctaccactccaatcgatgtttagtgtgataggacatcaccatttcaaggccccggg    3920
tgtttccaacgtcatggaagcagctgacacttctgaaactcagccaaggacacttgatatttttaatta    3990
caatggaagtttaaacatttcttttctgtgccacacaatggatggctctccttaagtgaagaaagagtcaa    4060
tgagattttgcccagcacatggagctgtaatccagagagaaggaaacgtagaaatttattattaaaagaa    4130
tggactgtgcagcgaaatctgtacggttctgtgcaaagaggtgttttgccagcctgaactatatttaaga    4200
gactttgtaaaaagaaaaatgtatatagctgtgagtttaaacaaaaaccacaaacagacaaacaagaaa    4270
aaaagctttattggtgtttttcactttgaaagagcttttagcaaggttgtgcttttcattgtgctctgta    4340
cgtatataaatatatatatatacacacacacacacattagtcatatcacctctgtttcctccccaa    4410
caaaagagggcttttcttcttaattacttctgtggtaaacaaaagacatgggattttcttacatgagattctca    4480
tttgtaggaggatgtgatgtcccacagaagacccagacggtctgtgtggcctatttccccgtcaggttg    4550
cacaggtgcatgcaagagcattcttaggagaccactgttttgaaaaacttttgacttgtacgtgttagcc    4620
ttcatgaaattgcagtacagagatgggtccccaaagtggagtgtatttacagcttcttaaattagagaca    4690
tgcacacacaaagaatcagtagggagaaacaaaaatacaagtcccgttctgtagctctggcccttttgaat    4760
atgtttaggaagagttgcttccatttcagggccctgccaaaaaaagaagaaagcttgcctttggtgggg    4830
ctatgcccttggagtaaatacggctctgtgttccctagcagctgcgggagggtttggccgatgaagtac    4900
ctgctcagcttagctaatcagattgaaggaagacatgtgtcttccttttgtttaagcactcggtccct    4970
tatttatcagtaagcaggttttaaaaatcttttatatcatttatgggatcaaacatatgattgtctgaa    5040
aacatcacttttttgtggatttgtgtatccggtcaccaaacggtgaatattatagaagaatgggggaagaa    5110
aggataagaatattaaaactgctttgcatgggttttctgggaaattaggataacttcactgagaagacatt    5180
gaatggaaattattcacccatttaaattggtgacctagggatcagagatttgtctttccaacagcttgt    5250
catttttcatttctcttctcatttttcaggaaagttttgagtgttataaggtggaaggaaacatagtag    5320
```

FIGURE 8A-65

```
caatggatacttttttgaaaaattattgcattaccaagaaacagtagccaaagatatttgaagatcatgt        5390
tcctcggctccattgtgggttattctagaaatccagtcttaaatctctccgctaaagtggacattcccca        5460
taaaaattgtccagctgcctggctcttttgcaataacaacctttgattactgaatccctacactcaaact        5530
atagtgatatatcagtgtttgagagtgacctctagaaaaaagaaaagtgtttttagaaatgcgtacaagt        5600
cacccccaaatcctattgcttatcttgggttaaatttgagagtgattctctgtatataaatatgtgaaat        5670
attattatctcaacttagcacacgtgaagcaacatttctttcctacagagaggtgtcatggtaagatttc        5740
attccgaattcattgtttcatagagctatgatcaggccattctgcaagcaatgtatgaccccacctgag        5810
caaccacaaataggctctctgtgaaactacaaaggaagttatgtgtggcatccatgttggtttcgtctgt        5880
ctgtaatgtgaattccagtatttgtttagtatttccagttgtctcctgctagcaatatgtacagtaacgc        5950
gtcaggcttgtgacatttgaataaggaaaaacagagttcctgttaagtgaataacttttagcttttacagg        6020
ggattatgatcaaagtgattttagtacatcttaaatgatatcttattctacatggaaagaagttatag        6090
aatcttcatagagttctatgagaaaaaatatacttgctatctataaaaaagagaaaaaagaaaaaaaatg        6160
agaaaaagtaagaaaaaaaaaatcctgtcctaggcttttactcttgatcttcaaaggcacgcagggtt        6230
taatggttccttgggttattattttgcagttttgtttttattttgccttaagtaatgatagaagatata        6300
tatggccggacacatatgtataaacttttcagcagcattttaataataaaatatcacagtattttctaa        6370
tgctttgtgcaaataattatgcgtccattcttcttggtaggtggcgtgttttatttactttgttgttc        6440
tttgaatgtcttttctttgtaaaaactaagtgatgcgcctgacataggctacaaatagataaatacatt        6510
tggtaatgggatagtttctttagctttggccagctgcacagttgaggaggctctgctggcctgattttgg        6580
aaaaccaagccctgtttggtgaagctcctcaggtgacactgtctgaaacggagtgtttggatttgttatt        6650
tctaccactgtgccttcttgcgtcactgtgttttgatttgtggtcaacaaaacactttcaaatagccttta        6720
ggtgagtaagcctgcaagtgacagcaagaaattctaccgaatgaaactcaagaggcagaaaatcactatc        6790
ataccaatgggagctcatttgtcaattcctcctgtgcatccaaccatcacgatcttatttgacattcgc        6860
agtagccctaaggggcacgcacctgcattgctcccctttcataatggaatatgttcagaggaaactagcc        6930
cctattcgacaggagaacttgatggataacaggatagtatatcctcatagccaaaatcttttcaccaaga        7000
agttatatggcaaacacttgtaagccaaggccctgcatgttgtgataatcctagctaagtatcagataaa        7070
gaaagatagcaaggacttggactctctgacatatgtgaactcctaaattcttcagatgttgtttgtctca        7140
atcgtgttgtgaaggcacacaggagaaatacatagacacacatacacatatatgtacattttatgtgtaca        7210
ttatatatgtatatacatgtacatatcctatatatgcattatgtatagagtcatgcacagcataataaca        7280
ttttggacaaatgcaaataacatgatgacaatctcaagagattataataacatttttcttgtgccttttc        7350
tatgtttagatatgtttagatacacaaatgctcatcattgtgttacagttgcctagggtcttctctccag        7420
tcacacgctgtagaggtttgtagtctggaagcactaggctataccatagagcctaggggtactgtaggct        7490
gcacctcgaggttttgtgtaagtacactacatgatgtttgcacaatgatgaaatcacctaacgatacattt        7560
ctcagaattgatccctattgttaagcgatgcgtgactgtgcatgtatacattacatacactgtatatgca        7630
cacatgcatatatgcatatatatgttacacatgtaaatatatacatagatatcacatacttaaattcctg        7700
aagatgccaattccgttaaacataaatatacacacactcatatatatgtgcacacacactcgtatatcca        7770
cacacaacatatttaatgtgctcatatatatattcctgggtgtgtgtgtgtgtgtgtgtgtgtgtgtgta        7840
tatatacatagaaaatacattagttctcttttatctgtgcaatcacattctgcagttttcaggtactgtgga        7910
caactgtggtgtaaaaatatgtgagtacagttcaatgagatattttgaaagaggccacactcacgtaact        7980
tttatgacagtatattgttataaatgttctcttttattagttattgttcatctcttactgcctctaatttt        8050
atgaactttatcaaagtgtgtacatataataaaatacatagtatataaagggtttggtactatctgtgg        8120
tttcaggtatccactgagttttgaacacatccccttggaaaagggccattactgaatatacacacacct        8190
agacacacatacagatacatagtacatagatatattcatagatatgcatgcacttaaatc        8260
tctaagaatggcatttgcattaaacacacatataaacacatgtatatacacacatacatatactata        8330
cttattgtcatcttcaggcattcaaagtcgaattttttagcaaatttcagctggagggagaatcactcttg        8400
ttttgactattttatgcattcttgttcattgtgaataacccaaggaatgctaaaaaatatatgcattcat        8470
taattcattcaacaaacctttactgaatatctccactgtcccaggccctgtgctgggctggtgttaaaat        8540
tgaagaaaaaacttctcacaccataaaactcaaggggaaggcagagaaacagaagcaaggagaggcag        8610
ggggtgctggagatggagatggcacccatgctaatacgtggtgctaagaaatgtctggacactgctctta        8680
acctagtctgggaaggttgggaacgtattctgtctgaagaaacctaagccagatctttccaactccgtag        8750
aaaaaatgacagtgggtggtgtgttgtggggaagatagaattccacaccttgaagtgagaagacagagg        8820
aagttgggaaaccatgctcctgcatcatgggtaaaaaatacaaggtatttttagaaaggtgcgaaata        8890
cgaggcagaaagaaactggctgataaaaaacctccagaggcaaggcagggagttttgggcttttgtcccaaa        8960
gtcaggagacgccaaatgattgcaccaaattggtgtatgagtgtagctgggacatttagcagtaattct        9030
caaaaattcacgttcttaggaacatgtaggacatctgcttaaagtgcagatcctattcaattgtggttt        9100
ggtgaacctgtgtctgcatttccaacgagctctcaaagtggtgcacatgttgctggtcctcaactaaccc        9170
caactcttttaggttgcaaaggatggagaactgtccacttagaagtaaccgtgagcatagtttgtatca        9240
gagtgagagggctctggatgcaaggaaagcattaaggaggcaggcaatctgttttgagaaattaatgact        9310
gtcctcttttcaagggtgatggcgatagtgataataagaaagcaaaaaaaaaaaaaaaaaaacaataaaaa        9380
cattgcatcattttatagctgcatgtaccagaactgattaggcgcagtcatcaaataccacctggaaccg        9450
catctgaagttaagcttgggtttaggaacttgtttcaacagagggagggcatacaaggagaatgatgagc        9520
tacctggagaggggttcagacgggctggtcaagggtttgggcttagactgggttgttttagaagtgcta        9590
agaggggcaagaacttgttcctgcattgctctggattgtttgctcatcaggataatggggatgtcaataacctttagccaa        9660
aaagtgacaggaccagagcatgactagcattgtcttcagtaaaaataagcagtggaagagaagggggattt        9730
gggtcgttattagtggttacaaattgttcatgtttctgtctcatcccgtgctggctgtgggctgccttc        9800
ttctgatgttgaagttctttcaattattttatgtgcagccggatgcaccttgacttagccattaattag        9870
caggctagttccagcagccagatatgagggctgtttctttttgttctttctcagaacttccagaatatgta        9940
ctcatatgtcccatctctcaggccacctggttcaaaaaaaatctaggttatgctaaggaagtgaaagtga        10010
cacttcctctgccaaattctcattattatattgaaagaaatggggatacaggaaaaagtccacggaaactc        10080
taccctctctaaaatgaccatccgtgtaaatacttagaacacccacaaataatcctgtttcctctagag        10150
gcaagagaatttagggaaatgagataaattagccaggggga        10190
```

FIGURE 8A-66

```
gcaaaccacttaacaatgacccaccacaaccctgctatttctgaatttaccttatctttttttttcctttcacaggcaga
ctataattatgatttcaacttcctcatcggatccccagtcatgaatctatctaacatattcagctgaaggctgtcaagga
tctactgattccacaatgcagtggtactctcccatcgcccttcactcctaaaatctctgaagaccatgacacagttgact
cctgcctactccttgtggaggttaaagtccttccttgaattccataccacactttctcttaccaaagatcttctgcagat
gggagaatgaccctatttaggttgttatcaagacccctacccagtgtcactttctccaaagatttgccttttctcttaag
ggaacactttctctatttacaccaaaatgttaagtatcatatccatagggtttgtgcttggatccgtagatcctacctt
aagatccctattcaggtcaaatctcctgtcccaaagatctcaggtctgtgggtcattggtatttctatgatccaccagca
cctcatttttctttccacacaagtgactctggctgagtgcactctcattcatcttagccttccatctcaccacatgaag
gctatctctagtatcttctcattttagggctccatcccattttgctcaacttctgcaactatgcatatagtcaaatgcc
actcatagtgaaataaattcatcataactgtgttattttcactaatactgccctaatttatgaatgcagcagcctcgctg
tactcttttgttctagaatgtcccagcccttaaatcccctcagagtaagctctctgaaaggtaatctctgctaccatccc
cgactaacacccataaggattccagccaatgaatattcatcaacctctgtagtccagcctgaccaatttcttcttattct
cctctatgaatcataagaacctatcatcagctcaccaccactcctgttttcagggtttaatttgaggattatctaaaaaa
gcaacctcatgtagcagggtggccccccaaatgcaggttccaagaactcactcaagacctgctaggtttgaatcctggtg
tttagctctagaggcatggattttgtaaccatcttcctgggtcatccttgtgcaccttgaacttccaaagcctttgctca
cactatatctgtttctcgtctccagatattgttaacttggaataatgtcccaccccctgctctccaattcccagggaaac
cttgttcatctgtgaaccattttctcagcatcccaataggaagcctgttacgccttctgtatgctttggagatggcatat
gtcacacattgagttgcattttaataattaaagagcttaatttatcctcttattagattttaagcaccttctatactata
catattctctctctaataatgattagtaattaacatagtatatattactattgcacgaaccaattattatcctactg
aaaatatttctgtttcacttggaccattgtattaggagagtcagtatgaatcagtagtgccccactggcttccaccagtat
tgcattcagagttctacgtattgatctcacaggagcttgaacataataccagaatgtggttgatggagacactgagatgg
aaaatcagagagaacaagtagtgtggtatagattatttctcatgttccctccagttcttgtaccaaactcagcttatata
tctttcttggaaccctacagttttatttcattttatgactcccccagctcccacatttcaccatactccacaattagatt
taaaatggaagcatgaagaatgatactcttatctcttccaggaattgtggatctaaacctctgtagctcctctgtctgtg
ttgcaatctggtggcccagttgttaaaaattggtgttttgggtcctatcctggtctcctgtaagggattttggattaggg
aaaatgataatttcataacatcttatattcacttttcttacaatcatgattccacctgtctaagatgctttctgacttt
tttctttttttgagggagggtctcattctgcaacccaggctggagtacagtggcacgatcatggctcactgcagcctcga
cctctctggctcaagtgaccttccccttcagcctcctgcactaccactcccagctagttttaatttttttatagaaac
agggtctcactatgttgcccttatttttcaaattattttaaaaaactctcaatggagtcattcagatagaagtgaaaatgt
gcttgcctgctctcttccaggtcacatatctcaggggaagagatctggtacccaaccaatccacccacaagctaagccaag
cattcagattttgcccaaactctccttcccaatcttacttatcatgctgccttatttagaagtgatgtctccccacatc
aacttctcttcccttcactaccttcccttccttttcctcccttcccttcctcttttctctttctctctctgtgtctc
tcattcaggacttcatttgttgcatccattcttgcaacaatcttacaaatattttctttctttccacgttggccctctt
caacttgttctccatattgccatcacagtgattgtcctaaaatataaatctgatcatttcttcccctctccctgcagaaa
atatgttactggctttcccactgcctactggataaattccacctttcagtatggcactcaaaattcttcacaattaggt
ctttaatcctttccttaccaccttcttttcatactcaatgtcatggcattccaaaccctccctatttctagatctccaca
catacagtattgctatgatgtctttatccatggcttctttctcaacttcttgacccaatcagtgtctgtgtaccatttct
tccctactcagaaagttcttccttgcaaacccttcttcaatcattttcacctccatgggtccctatgaattcatatgta
ttccttgtgcacaccttcttgtaatcatattttttctcatgcttttggctatcttgtccactagactgtatgctttctca
aaaataaatggatgagtttcactcacagatgcatgtcagtgcttaggactgcaccagtgctaaaaaaaaaacaaccctga
atttatgataagtcaatgaattaatacattcttggcaaaacccatgactttctggcctactataaattactgtgttcaa
ggtgagattctgcttagtttaggatatagatatctatatatatgtccatatatctgcagctatatatccatatccatgt
atatcactgatttgggaataagctatacttattaacaatattactatgttaatgggtcttcaatatctatacaataacg
gaaaagtacatgcatatttctaaatatctatccaataattggaacacacacgtatgtatggatggatatatttttttttt
attattgggtatagatatctattaatagataagtgtatatttatgtacctatcttgttggtaaaaggtgcttttatacat
attattttcatttagtctccacaagaaatccacaggaaagtaattttaatctcagtttaacagattcacagaacataact
gactttacaacaaggcaaagtttgtgaggatagagtcttaacatgaaaccaggtccccaaattggtgtctatcaccttcc
ccattattggtcaggctgcccaaatatccttcacatcaccatggcaggcttcatgctttggtttactgcctaaagccgaa
gcaattaggaggatatcctatgtgttgcggacactatcttttccttccataaatgaattaatgggccatgaaataattt
taagaaagctaacttttctggccaagcagaagaataaaagtaatcaccatgtaatattgttgtgaagactacctggccc
```

FIGURE 8B-1

```
cacacattaactcagctaatcattacagtattacacggtgattatctgttccattttacagatacagaaatggaggcaaa
cgattaaaatacacacctaaggtcacatgcatcttgaacccaagcaatctcattttaaaatccgtgttcattgtcacaac
actctattatgccctctgatctttgcattgccaatttaaatccaactttctccaactcaactttaagtacaggggtcata
cccccgtcctcgccccccgcaacttgaaactccctgggaaagataacctcctggaccctggaaatgaagaggcgtattta
aaaacaaatgcctcatcctgggcacaattccaacattttatcaaaatcatgaaagtataagaatagaagtaaacaaaaag
ctttcatcgatcccctctcaaccatacccctgagcataaaacaggtcctgtactttacagaactgtattccaaattttgct
gctcttaaaaattttttttatatcattgcttcccaaatgaattacaataacgcagacatagagactgctggagatcgtga
ccttaaacagttaaagatgtttgcatatactgcagcatgtttggtgtggagggtatctagagagtcctaaaaaagcaaag
aggaagaaggtttgctgtacgcgtctggtgcggtggcaccgtttgccatgcccacctgctctatctcccgagtacccggg
atctctccgttacagctggtttgcattggattagcagctctttgcatgaggttgtagctgtggatgtggtttctgtagt
gatggggccgactccggagatctattggctgctggctttgtaaatttcattcagtttggtccaatggcagagggagagcc
ccggagacagcaggacctctctcctcaatctctcttttcttgcagaaccgtctctctcccttctctgtctcttagcaca
gagctcttattcagccactagcttggcccttcctgcttcaattgtaatgcttgttctgcccgtccacagactattggcgg
cagaaacaacgaatttcctccaaactaggcggtgttggtggctcttgcattcctctggatgaggaaatctagttgggggg
ttccAGAAGGGGAAGGCTCCTGGGCTTTCAATACATCCTCCTGAATCATACCTCGTTTCGGGTTCCCTAGAAAAATCTGG
ACGTGTAAAAGAACTCTTAACGGCCGATGCAGCTCTTCCAAAGCTAAGgtaggtgcagttttaagacctgtctctggga
cattattctcattttaaaaagccgtttaaacattttgacttgcagcaaaggatggaaagcctcactgcagatacttgagc
ttcacttcatctgatctttatttttcctttatgattattaatattattttggaaaatttggacaggactttctccca
tctgtctcgctgcatttcttaggtgtgggtgggagtgtagaccttcatacggtttttacatgcaacctctccacagaaat
atttggttttattttcacttaaagagaaaaatccagaccaccgttgtttggaagcgttttgctgcaatcagctatttgaa
cggctctgggccgtgtgtgatgtgtttacaaagtagcgctgccttccacacaaataaacagaagactgtggcggggaga
ggaggaaaaaaatatatatgtatctgcagtacagggagaagaggagagaagcggccagggctggagatggtgaaggcag
gaagacttctgcaaactgtgaggcatgggaggcttttcttttcttttctctccccccccacccccccccttattcttt
aagaaaactgtcagctaccaccgcctggggtgctttttgaggggttggggggggtgctgttaaccagaaagaaaaaggga
aaaccggcttggttggggtcgcATTTAAGCGATTTTTTTTCCCTCCTTCATCTCCGGGCCTCGGATAAGATGACGGCTTG
GGTGATGCACGAAATAACGCACGTGATTGATTAGACCTGGCTTGGCTTGGCTAGGGAACGATCCAGGCGCGCTGGAGACC
CCGCGTGAAGATGAAATGACGgtagctccgggctgcttctgtaaaccggggagcgggctccatgcacccctttcccgtgt
gtgtgggtttcgaggcgggtggggaagggtgaggcaagccgcagaaggagggtagagctggtggttttgcttctttcggag
cctttgagtgtagtctgaacctttgaggggggcgcggggggggcttgcagctgccgccctgggaaccatctctgaactgcc
cgcttttccgaaggagcggaaaagttggaagctgcgaggacagactaccggagccctggtctgggtctcgggggatctgg
agccctagtcggtgcccactgagaacacccccttctcggagcgagggtgtcggggggagtgttaagcctgcggggcgcacg
gtccgccagtccccgaggtggggacggggggaggaggctgaggagtcggttccaataggcgcaccacctctacagccctgg
aaaacgcaaccgccaccccctcttcccttccatcccatcccaagcctctctgctgtcccgggccgatttcatctcgtctc
ttcccccgcctccccgcttcccgcctcccaattcccgcgcggctcggctcagccccttcccactccagtgggcagaact
gatggagaagatccgccaagcgcgcagccggcggcggaggagacagtgcggggtgggcgagggcttcgagaccacgcag
agagagagtgaacttcagtcctgacccctccccaaggccgcggctggggcgcccacagcccgcgctggcacccgcgtggc
ctgacctgcggaagcgcgagcggggatgaggtagggagaggggaggtaggtgccgctcggctgcagatgatgcgtgggtgg
ggggcttgctgtgggaggagaggcccaggtcccggcctgc
```

FIGURE 8B-2

>HNL4X cDNA (SEQ ID NO:2)

Exon 1 (1-159)
Exon 2 (160-936)

Exon 3 (937-1089)
Exon 3bis (1090-1200)
Exon 4 (1201-1386)
Exon 5 (1387-2176)
Exon 6 (2177-5565)

ORF (465-3023)

```
atttaagcgatttttttcccctccttcatcgccgggcctcggataagatgacggcttgggtgatgcacgaaataacgcac
gtgattgattagacctggcttggcttggctagggaacgatccaggcgcgctggagaccccgcgtgaagatgaaatgacgg
ctgccttggagttttcataagaaattgtccctggaggtgttggatgatcacagcttccttggagcattgcagttgctgga
atccagtttcaggattaagggagggctgcctccttgcaatgggctgccaagaaaacggctgtgcttgttcttaacctcag
gctctgtctgtgatcagtctgagagtctctcccaggtctactgctccctggaaagcccctatctctctgcaggctcgcctc
tgggctttgtctccttggagccacatcactgggacagctgtggatgtggatgcagatttgaaccATGTCACGGCCCCAGG
GACTGCTATGGCTTCCTTTGTTGTTCACCCCGGTCTGCGTCATGTTAAACTCCAATGTCCTCCTGTGGTTAACTGCTCTT
GCCATCAAGTTCACCCTCATTGACAGCCAAGCACAGTATCCAGTTGTCAACACAAATTATGGCAAAATCCGGGGCCTAAG
AACACCGTTACCCAATGAGATCTTGGGTCCAGTGGAGCAGTACTTAGGGGTCCCCTATGCCTCACCCCCCACTGGAGAGA
GGCGGTTTCAGCCCCCAGAACCCCCGTCCTCCTGGACTGGCATCCGAAATACTACTCAGTTTGCTGCTGTGTGCCCCCAG
CACCCTGGATGAGAGATCCTTACTGCATGACATGCTGCCCATCTGGTTTACCGCCAATTTGGATACTTTGATGACCTATGT
TCAAGATCAAAATGAAGACTGCCTTTACTTAAACATCTACGTGCCCACGGAAGATGATATTCATGATCAGAACAGTAAGA
AGCCCGTCATGGTCTATATCCATGGGGGATCTTACATGGAGGGCACCGGCAACATGATTGACGGCAGCATTTTGGCAAGC
TACGGAAACGTCATCGTGATCACCATTAACTACCGTCTGGGAATACTAGCAGAAAACACACTGGCTCATGGAAACTGCAA
GCATCGTTGTCAGCTGCACCTGCAGGCACCATGGGGTTGCAAGTCAGCATCCCCTTTCAGAAATGAGGATGGAATTAGAG
GGTTTTTAAGTACCGGTGACCAGGCAGCAAAAGGCAACTATGGCTCCTGGATCAGATTCAAGCACTGCGGTGGATTGAG
GAGAATGTGGGAGCCTTTGGCGGGGACCCCAAGAGAGTGACCATCTTTGGCTCGGGGGCTGGGGCCTCCTGTGTCAGCCT
GTTGACCCTGTCCCACTACTCAGAAGGTCTCTTCCAGAAGGCCATCATTCAGAGCGGCACCGCCCTGTCCAGCTGGGCAG
TGAACTACCAGCCGGCCAAGTACACTCGGATATTGGCAGACAAGGTCGGCTGCAACATGCTGGACACCACGGACATGGTA
GAATGCCTGCGGAACAAGAACTACAAGGAGCTCATCCAGCAGACCATCACCCCGGCCACCTACCACATAGCCTTCGGGCC
GGTGATCGACGGCGACGTCATCCCAGACGACCCCCAGATCCTGATGGAGCAAGGCGAGTTCCTCAACTACGACATCATGC
TGGGCGTCAACCAAGGGGAAGGCCTGAAGTTCGTGGACGGCATCGTGGATAACGAGGACGGTGTGACGCCCAACGACTTT
GACTTCTCCGTGCCAACTTCGTGGACAACCTTTACGGCTACCCTGAAGGGAAAGCACTTTGCGGGAGACTATCAAGTT
CATGTACACAGACTGGGCCGATAAGGAAAACCCGGAGACGCGGCGGAAAACCCTGGTGGCTCTCTTTACTGACCACCAGT
GGGTGGCCCCCGCCGTGGCCACCGCCGACCTGCACGCGCAGTACGGCTCCCCCACCTACTTCTATGCCTTCTATCATCAC
TGCCAAAGCGAAATGAAGCCCAGCTGGGCAGATTCGGCCCATGGTGATGAGGTCCCCTATGTCTTCGGCATCCCCATGAT
CGGTCCCACCGAGCTCTTCAGTTGTAACTTTTCCAAGAACGACGTCATGCTCAGCGCCGTGGTCATGACCTACTGGACGA
ACTTCGCCAAAACTGGTGATCCAAATCAACCAGTTCCTCAGGATACCAAGTTCATTCACACAAAACCCAACCGCTTTGAA
GAAGTGGCCTGGTCCAAGTATAATCCCAAAGACCAGCTCTATCTGCATATTGGCTTGAAACCCAGAGTGAGAGATCACTA
CCGGGCAACGAAAGTGGCTTTCTGGTTGGAACTCGTTCCTCATTTGCACAACTTGAACGAGATATTCCAGTATGTTTCAA
CAACCACAAAGGTTCCTCACCAGACATGACATCATTTCCCTATGGCACCCGGATCTCCCGCCAAGATATGCCCAACC
ACCAAACGCCCAGCAATCACTCCTGCCAACAATCCCAAACACTCTAAGGACCCTCACAAAACAGGGCCTGAGGACACAAC
TGTCCTCATTGAAACCAAACGAGATTATTCCACCGAATTAAGTGTCACCATTGCCGTCGGGGCGTCGCTCCTCTTCCTCA
ACATCTTAGCTTTTGCGGCGCTGTACTACAAAAGGACAAGAGGCGCCATGAGACTCACAGGCGCCCCAGTCCCCAGAGA
AACACCACAAATGATATCGCTCACATCCAGAACGAAGAGATCATGTCTCTGCAGATGAAGCAGCTGGAACACGATCACGA
GTGTGAGTCGCTGCAGGCACACGACACACTGAGGCTCACCTGCCCGCCAGACTACACCCTCACGCTGCGCCGGTCGCCAG
ATGACATCCCACTTATGACGCCAAACACCATCACCATGATTCCAAACACACTGACGGGGATGCAGCCTTTGCACACTTTT
AACACCTTCAGTGGAGGACAAAACAGTACAAATTTACCCCACGGACATTCCACCACTAGAGTATAGctttgccctatttc
ccttcctatccctctgccctacccgctcagcaacatagaagagggaaggaaagagaaggaaagagagagagaaagaaa
gtctccagaccaggaatgtttttgtcccactgacttaagacaaaaatgcaaaaaggcagtcatcccatcccggcagaccc
ttatcgttggtgttttccagtattacaagatcaacttctgaccctgtgaaatgtgagaagtacacatttctgttaaaata
actgctttaagatctctaccactccaatcaatgtttagtgtgataggacatcaccatttcaaggccccgggtgtttccaa
cgtcatggaagcagctgacacttctgaaactcagccaaggacacttgatatttttaattacaatggaagtttaaacatt
tctttctgtgccacacaatggatggctctccttaagtgaagaaagagtcaatgagattttgcccagcacatggagctgta
atccagagagaaggaaacgtagaaatttattattaaaagaatggactgtgcagcgaaatctgtacggttctgtgcaaga
ggtgttttgccagcctgaactatatttaagagactttgtaaaaagaaaaatgtatatagctgtgagtttaaacaaaaac
cacaaacagacaaacaagaaaaaaagcttttattggtgttttcactttgaaagagcttttagcaaggttgtgcttttcat
tgtgctctgtacgtatataaatatatatatatacacacacacacacacacattagtcatatcacctctgtttcctcccca
acaaaagaggcttttcttcttaattacttgtggtaaacaaagacatgggattttcttacatgagattctcatttgtagga
```

FIGURE 9A-1

```
ggatgtgatgtcccacagaagacccagacggtctgtgtggcctatttccccgtcaggttgcacaggtgcatgcaagagc
attcttaggagaccactgttttgaaaaacttttgacttgtacgtgttagccttcatgaaattgcagtacagagatgggtc
cccaaagtggagtgtatttacagcttgttaaattagagacatgcacacacaaagaatcagtagggagaaacaaaaataca
agtcccgttctgtagctctggccctttgaatatgtttaggaagagttgcttcccatttcagggccctgccaaaaaaagaa
gaaagcttgcctttggtggggctatgccccttggagtaaatacggctctgtgttcccagcagctgcgggagggtttggc
cgatgaagtacctgctcagcttagctaatcagattgaaggaagacatgtgtcttttcttttttgtttaagcactcggtccc
ttatttatcagtaagcaggtttttaaaaatcttttatatcatttatgggatcaaacatatgattgtctgaaaacatcact
ttttgtggatttgtgtatccggtcaccaaacggtgaatattatagaagaatgggggaagaaaggatagaatattaaaact
gctttgcatgggttttctgggaaattaggataacttcactgagaagacattgaatggaaattattcacccatttaaatt
ggtgacctagggatcagagatttgtctttccaacagcttgtcattttttcatttctcttctcatttttcaggaaagtttt
gagtgttataaggtggaaggaaacatagtagcaatggatactttttgaaaaattattgcattaccaagaaacagtagcc
aaagatatttgaagatcatgttcctcggctccattgtgggttattctagaaatccagtcttaaatctctccgctaaagtg
gacattccccataaaaattgtccagctgcctggctcttttgcaataacaaccttttgattactgaatccctacactcaaac
tatagtgatatatcagtgtttgagagtgacctctagaaaaaagaaaagtgtttttagaaatgtgtacaagtcaccccccaa
atcctattgcttatcttgggttaaatttgagagtgattctctgtatataaatatgtgaaatattattatctcaacttagc
acacgtgaagcaacatttctttcctacagagaggtgtcatggtaagatttcattccgaattcattgtttcatagagctat
gatcaggccatttctgcaagcaatgtatgaccccacctgagcaaccacaaataggctctctgtgaaactacaaaggaagt
tatgtgtggcatccatgttggtttcgtctgtctgtaatgtgaattccagtatttgtttagtatttccagttgtctcctgc
tagcaatatgtacagtaacgcgtcaggcttgtgacatttgaataaggaaaaacagagttcctgttaagtgaataacttta
gcttttacaggggattatgatcaaaagtgattttagtacatcttaaatgatatcttatttctacatggaaagaagttata
gaatcttcatagagttctatgagaaaaaatatacttgctatctat
```

FIGURE 9A-2

>HNL4X : protéine (SEQ ID NO:3)

Signal peptide (1-43)
Esterase domain (44-634)
Transmembrane domain (712-733)
Required for binding to PDZ domains (851-853)
Extracytoplasmique domain (1-711)
Intracytoplasmique domain (734-853)

MSRPQGLLWLPLLFTPVCVMLNSNVLLWLTALAIKFTLIDSQAQYPVVNTNYGKIRGLRTPLPNEILGPVEQYLGVPYAS
PPTGERRFQPPEPPSSWTGIRNTTQFAAVCPQHLDERSLLHDMLPIWFTANLDTLMTYVQDQNEDCLYLNIYVPTEDDIH
DQNSKKPVMVYIHGGSYMEGTGNMIDGSILASYGNVIVITINYRLGILAENTLAHGNCKHRCQLHLQAPWGCKSASPFRN
EDGIRGFLSTGDQAAKGNYGLLDQIQALRWIEENVGAFGGDPKRVTIFGSGAGASCVSLLTLSHYSEGLFQKAIIQSGTA
LSSWAVNYQPAKYTRILADKVGCNMLDTTDMVECLRNKNYKELIQQTITPATYHIAFGPVIDGDVIPDDPQILMEQGEFL
NYDIMLGVNQGEGLKFVDGIVDNEDGVTPNDFDFSVSNFVDNLYGYPEGKDTLRETIKFMYTDWADKENPETRRKTLVAL
FTDHQWVAPAVATADLHAQYGSPTYFYAFYHHCQSEMKPSWADSAHGDEVPYVFGIPMIGPTELFSCNFSKNDVMLSAVV
MTYWTNFAKTGDPNQPVPQDTKFIHTKPNRFEEVAWSKYNPKDQLYLHIGLKPRVRDHYRATKVAFWLELVPHLHNLNEI
FQYVSTTTKVPPPDMTSFPYGTRRSPAKIWPTTKRPAITPANNPKHSKDPHKTGPEDTTVLIETKRDYSTELSVTIAVGA
SLLFLNILAFAALYYKKDKRRHETHRRPSPQRNTTNDIAHIQNEEIMSLQMKQLEHDHECESLQAHDTLRLTCPPDYTLT
LRRSPDDIPLMTPNTITMIPNTLTGMQPLHTFNTFSGGQNSTNLPHGHSTTRV

FIGURE 10

>gène HNL4Y, séquence complète (Homo sapiens BAC clone RP11-224C16)
(SEQ ID NO:4)

Contig joins AC010726 (153001-176524); AC010979 (201-109394)
AC010879 (201-181721); AC011903 (63481-42522)

Simple repeat (9811-9852)
Simple repeat (9865-9918)
C/EBPalp (10104-10114)
Sp1 (10151-10161)

Exon 1b (10156-10298)
Exon 2 (108500-109001)
Exon 2bis (205869-205928)
Exon 3 (209526-209679)
Exon 3bis (235028-235139)
Exon 3ter (238090-238212)
Exon 4 (310597-310783)
Exon 5 (316139-316929)
Exon 6 (326822-330136)

```
aggatgtgggtggggccagataacagaataaaagcaggctgcacgagccagcagtggcaacccgctcggg      70
tcccccttctacactgtggaagctttgttctttttgctccttgcaaaaaatcttgctattgctcactctttg    140
ggtccacactgcttttatgagctgtaaacctcaccgcgaaggtctgcagcttcactcctgaagccagcga     210
gaccaccgggaggaatgaacaactccggacacaccgcctttaagaactgtaacactcaccgcgagggtcc    280
acggcttcattcttgaagtcagggagaccaagaacccaccaattctggacacacctgtgaggtcaggagt    350
ttgggaccagcctgggcaatctagtgggaccctgtcttaatattacattgttcctaaataattgtggttt   420
ttgccattaaaagtaattgtgaaaaccaaaactacttttgcacgaacttaataaaaattatgaaatagct   490
gggcgtggtggcacatgcctgtagtcccagctaccgaggaagctgaggcagaaggatcacttgaaccca   560
ggaatttgaggttgcagtgagctataataatgcctcaacagagcagactgtctctaaaaaaaaaaaaga    630
aagaaatgaaaacaaaacaaaacaaaacaaaatatgatgaagatccagaaggatgtgcagcccatctct    700
ttgccattcattacacttctgtcttcatatctacttcctccatttccaccggacaaggtgaaaaagcat    770
gaccagttaggcctctaaatttacctgttgcccatctactcctctagagccactgtttgctgtgtacatg   840
gctgtgtccatggattgcggtgtcacagttgtgagacagatttccagggaatgcatatccatagtccagc    910
ttagcttacatgctcaatcttgtaccaagcaacgtggccagaagatgcaaatctctttggatagaccgg    980
aaactcctattttaactctgagcctgtatgaccagatgccttgaaggccatgcaaatctgtcctgcaggc  1050
aagagcttctccaatttcagcatttggttcagcatttggtgcaaatcaccagagaacatgtttgacacag  1120
ttgacctgggggtggagacccaaagttatgcattttaacaggcttccaggtattaataacacccatgata  1190
ttagatccaggactataatctgtttagcaaagtaccaaaactttagatcttttttgtatatttggaggaaa  1260
agaacaagtattgcatgggtgttctttacataatttagtcatgacaattccaggagaatattaccaggc  1330
tcctaatatgccagtgctttataacagatcctcactcaaaacaatcccatttgtatttatacatat      1400
gttccatctgctctgtttccacttgtatacatacacaggtgtgtgtacttgtaacatgcaatacagttt    1470
tgcaatacattccctctcttctcaatgaatcatacctgaaagaaaaacaaaaggggtgttttttaaaatga 1540
ttccaatacaggctttgagtttgaaagaataaaagagagccattgtcttagaaattttttgtcaacctca   1610
ttttatttcaactaaaatttgtaaaccatactgcattcaccagagaaggtgtatatggctatatgcctat   1680
gtctgacactggtaattaaaaagagagaagcctgtttgcttgacttgataaataaaacatattgatgc    1750
tacctcttattatgtcttcccctatgttaaatgtttcttttttgaaaatatagattatttgaagtacaaa   1820
gcaagaaagcaggaagagagtgtatgtgcacacacagaagagagatacaatcaggcataaatcccaccatc  1890
ctgggaatataaaaccctctgtatcatatacatatatatatatacatataaaaatatagatatagataaa   1960
tctctacatatcaatatatagatataactatacatatagacagatacatccatatctctatagatatcta   2030
tagaagctacagatatacatatatatttctacagatatacagatatcctacagatatcatagagataggt   2100
acagatatgtattgaaatacacatagcaatctttataaacacctattatagagaggtagatgtatggatc   2170
tatatagatctatctatctatataccctatttctaaatctctctctctctctgtgtatgtatatatatata  2240
tatatatatatgtgtatatatatatatatatgtatatatatgtacatcaacaattccaaggtcc         2310
caattaacttggagaaagatttatgtatatttgcatactttttaaagggtagggcatgtgccattcatcaa  2380
agagacatatacattgtaaaagattttcatttaaaagtcttaggcaagaacattggtgcagtcactgtat   2450
aatgtcatttaaaaatgaactctatttagggcctcttatttgaaattcaatatccttgtttttcttacaa   2520
aagcaatagttaatggatttctcaccatcaatgaatgttacacaataaatgatgtgttatgggtttgaaa   2590
taacaggtttcagaagactaaatccttcaagaaaactgaaatatcttgcccacaaagaaatctttattcc   2660
catttatcagatgcaaaacttgaattaagggcctgtacaaccttcttactggaaaacgtgaacttaaagt   2730
atttccgtcaaggtttattaatcttataaaatactttccctacaaaaccaagggaataaacaagatcat   2800
ctctttatctcttccaactgtatttctgtaactatgtttatgtgtaaaaaaagtacctccatcaactat    2870
ttcaagaaaatctcatttaagtgactgaaattaatttttaaatttatgataacccaactttaaactggtctg  2940
gagtttacttgatatcattgaaagaaaaaggttatttagcaacagaatgaaatttgctaaaccttaagg    3010
gtgcaaacatttctaaggtatatgtcatattactcttattgaatccatgttgttaattatcttactctgt   3080
aatctagactttaaatcctgtttgggaataacactcctttaaatgttttctaaaaaattgagtatgttgtt  3150
tacccctagtttatgatttatatatagataatatataacttaacattatatattttaaatatataatatct  3220
```

FIGURE 11A-1

```
atattcatatgtggatatagatagatataggtatcaaaacagatattatacaaatgttacttttttgtcct      3290
atgatttctgatgtatattaaaacttatgctctgaactggcctcatataattgtgaaacctgtggcattt      3360
atcatcaatatgttgcagagacttttttctaaaccatgcctaaaatagcaaataaaagtaagaaacacca      3430
taaataaactaacagatacataaaaataaaatgaggaaattgtttggattagaagggggcatggggtaaag     3500
aattaggtatgtgagagcaaaaactatgtcttatttatccatcttttgtattttgcagagtttgtggaaa     3570
agcaacagttctcacattcatgcttagtgaataagtgaataaaaacaacaattagcaaaccacttaaaaa     3640
tgacccactgtgaatcacaaggtcaggagatcgagaccatcctggccaacatggtgaaatctcccctcta     3710
ctaaaaattagctgtgtgtgtggtggcgtgcacctgtagttccagctactcgggaggctgactcaggagaat    3780
tgcttgaatctgggaggtggaggttgcagtgacctgagatcccaccactgcactccagcttggcaaaact     3850
ataagactccatctcaaaaaaaaaaaaaaaaagatccaccacaagcctgctatttctgaatttaccctt     3920
atcttttttttttctttcacattaagactataattatgatttcaacttcctcatctgattcccagtcatga     3990
atctatctaacatattcagctgaaggctgtcaatgttgtactgattccaaaatgcaatgatactctccca     4060
ttttccttcactctaaaatctctgaagactgtgacacaattgactcctgcctactccttgagaaggtta     4130
caatccttccttgaattccatgccatgttttctcttgccagagatctttgcagatgggacaatgaccta     4200
tttcaggttgctatcaagaccctacccagtgtcacttcctccaaagatttgcctttccttttaagtgaac    4270
gctttctctattttacaccaaaatgttaagtatcatatccacaggttttgtgctcagatctacagatcct    4340
actttaagatccctattcagatcaaatctcctctcccaaagatctcaggtctgtgggtcattggtatttc   4410
tatgatccacaagcatctcatttcttccatacaagtgactttgggtgaatgcactatcactcatcat     4480
atcctccccatagcaccacatcaaagctatctttagtcttttctcatttttagggctccatccgtttta    4550
ctcaacttttgcaactatgcatatagtcaaatgccatccatagtgtgaaaaaaattactactactctgaaa    4620
tttccctattactgggtattttcactactaatatccctaatttatgaatgctgcagtatcactgtcctctt    4690
ttgttctagaatgtcccggatcttaaattccctcagagtaaattctctgaaaggtaatctctgccaccat    4760
cccccactaacaccaataaggattccagtcaatgaatattcataatcctctgtagtccagcctttctttatt   4830
ctcctctttgaatcacaagaacctacaagtagctcaccaccattcctgtctcagagttacttgagta     4900
ttatctaataaaacaacctcatgtagcagggtggccccacatattcaggttcccagaactcactcgagac     4970
ctgtgaagtttgaatcctggtgtttagctctagaggcatggattttgtaaccatcttcctgggtcatcct    5040
tgttgaccttgaagttccaaagcctctgctcactccatatctatttctcttctctagatattattaactt   5110
ggaataatttcccatatctactctccaattcccccagaaaaaactgttctgtgaactttttctcatcat   5180
cccaataggatgcttgttatgcctttcctgtatgctttggagatgcatatatcacacattgagttgcattt    5250
taataattgaagagttttaaatttattccccttattagatttaagcatcttttatgctatacatatttatct    5320
ttccaataatgattaataacatagtatatattattattgcactaacaattatcctactgaaaatatttgt     5390
ttcaatttgaccattgtattaggagagtcaataggaatcagtagtgccctatagtgtatctggcttcacc    5460
agtattgtattcgagttccacatattgtcccatgatgaatattagtatgtgaatgtatg               5530
tatgttcataatagtatgaacataacagtatgtagaatgtagttgatgaagacactgagatggaaaatca   5600
gagagaacaagtaatgtggtatagattatgtctcatgtttcatccagttcttgtaccaaacccagctta    5670
tatatcccttctaggaaccctactgttttatttcatttttatgaatcctcctagctcccacatctcaccata   5740
ctccacaattagatttcaagtggaaacatgaagaatgatatccttatctcttccaggaattcagaattta    5810
aacctccgaagctcttctgtctgtatcgtaatcctgtggctcagttgttaagaactggtgtgtttttaggttc    5880
tatcctggtcacttatgagggattttggattagggaaaattataaactcataatatcttatattcacttt   5950
ttcttataagcatgatccattgtctaagatgctttcttaattttttttttttttgagggagggtttca    6020
ttctgcaacacaggctgggtacagtggcatgatcatggctcactgcagcctcaacctctctggctcaag    6090
tggccaacctcagcctcttgaatagctggtaccacaagcatgcactaccactcttatttttaattttt     6160
ggtagaaacaggatctccactacattgcccagggtgatatcgaactcctgggctctagtgttccccctgcc    6230
tcagcctcccaaagtgcagagattccaggcatgatccactgctcctggccttttttttttttttaagaaa   6300
ttaattaattaatttttaaaaagtcttagtgaagtaattcagacagaagtgacttgtctgctctctcccag    6370
gtcacatgtctcagggaagagatctgctacccaaccaatgcacccacaaactaagccaagcattcagatt   6440
ttgcccaaaatctccctcccaaatccacttttatcatgctgccttaaagtatttagagttgatgtctcccc    6510
acagcaatctccactccctcccttcgcctctcccctcccctcatctccctgccctccactcccctcca     6580
cttctttctgtcccttctttttctccttttctctttctctctctgtctctctcattcaggacttgatt     6650
gtcacagccattcttgcaacaaccttacaaacatttctttgctttccacattggccctcttcaactagt    6720
tctccatgttgccatcacagtgattgtcctaaaacataaatctgattatttcttcttccctcactgcaga    6790
aaatgtgttattggcttcccactgcctactggataaattccactttcagcatgcatgcttttaaaactct   6860
tcacaattaggtctctaatccttttcctcactacctttcttcaaatttcaatgtcctgccatgccaaaccc   6930
tccctatttctagatctccacacatacagtattgctgcgatgtcttagccatggcttcttttttcaactt   7000
cttcaaccaatcagtgtcgatgtaccattccttccctactctgaatgttcttcctttgcaaaccccttggt   7070
taattatttttaacctctatgggtccctattaattttatatgttgtacacaccttcctgttaatcac     7140
attttttttctcatgcttttcattatcttgtctactataatgtatgctttctcaaaaataaatggataagt    7210
ctcactcacagttacatgtctgtgcttaggactgtgtcagtgctaaaaaaaaaaaaacctgaacttatga    7280
ataagtcaatgaattaatacattcttggcaaagtccatgactttgtggcctattataaattagtgtgttc   7350
aagttgaggttctggtttagtttaggacatagatatctatatatagtccatatatctacatatatatgtc    7420
tacatccatgtatatcactgatttggggggataagctgtatttataaacatactatcatgttaatgggtc   7490
ttcaatatctacacaataatgtgaaaaaagtatatgtatatttctaaatatctaatgggaacacacacaca   7560
tatatgtatgtatgtatatacattttctcttattattggctatagatatcttttaatagataagtgtatc   7630
tatgtaccaatcttgttggcaaaggatgctttcatgcatattatctcatttagtccccacaaggaaaagc    7700
aacccacaggaaaggtaataataatgtcagctcaacagagtcaacagaataactgactttatgacaagg    7770
caaaatttgtgaggatagagtcttaacatgaaaccaggtccccagattcatgtccatcatcttcccccatt   7840
attgctcatgttgtccaaaatcctttcgcatcatcatggaaggcttcatgcttaggtttacttcctaaagc   7910
agaagcaattaggagaatgtcctatgtgttgtggacattatcttttttcttccataaatgaattaatgg    7980
gcaatgaaataatttttaagaaaaagctaactttttatagccaggtagaataaaagtaatcaccatgaaatat   8050
tgtgaagataagcaggcccccacacactagctcagctaatcaatatgacaatattacatggagattatctg   8120
ttccatttttacagatgcagaaatggaggcgaatattaaaattcattcctaaggtcacatgcaacttaaac   8190
ccaagcaatctcatttttagaatctgtgttcattgccacaacattctatgatgtactctgatctttgcatt   8260
gccaatttaaatccaactttcttgaagccaactttaaatactgggaactttaagcattgtcaatttcaag   8330
```

```
ccaactttctccaacccaatttttaaatacaggggtcacaccctcctcctcgccccctgcaacttgaaact    8400
ccctgggaaagataacctcctgacctgggaaatgaggagtatttagaaacaactgcctcttggtaagca      8470
cacctcctatattttatccaaatcatgaaattataacaatagaagtaaacaaaaagccttcattcatcct    8540
ctttcaaccataacctcggcataaaaagctcctgtactttacagagctgtattccaatttcgctgctct    8610
taaaattttttttaatatcattgcttcccaattgactcacaataacgcagacatagggactgctggagac    8680
tgtgaccttaaacagttaaagatgtctgcatatacgacatcatgtttggtgtggagagtacctagagatt    8750
cctaaaaaagcaaagaggaagaaggtttgctgtgcgcatctgggtaccctgctctatctccagggttccc    8820
aggatctctctgttacagctggtttgcactgggattagttgctctttgcatgaggttgtagctgtggacg    8890
tgggttttgtagcgattgggacgactctggagatctattggctgctgggtttgtaaatttcattcattt    8960
ggtccaatggcagaaggagagcgccggaagcagaaggacctctctccctagctctctttttcttgcaga    9030
gacatctttctccatctctgtctgttagtacagagctcttattcagccactagctcggcctttcctgct    9100
tcaattgtaatgcttgttctgcccggggacacactattgacagcagaaacaatgaatttcctccaaaccc    9170
ggcaatgttggtggctcttgcattcctctggatgagcgaatctagttggggggtccccgaaggggaaggc    9240
gcctgggctttcaatacatcctcctgaatcatactgcgtttcaggttccttagaaaaaatttggatgtgta    9310
aaaagaactcttaacggcgatgcaggtcttccacagctaaggtaggtgcagttttaagacgtgtctttcg    9380
catattattatccttattttaaaaagccgtttaaacaatttgacttgcagtggctctccagcaaaggagg    9450
gaaagcctcactggcgatatttgagcttcatttcatctaatatttatttattttttcctttttattattat    9520
tattattggacaatttgggctggactctctcccatctgtctcgctccatttctttggtgtggatgggaat    9590
gtggacatcgatgtatggcttttacatgcaatctctccacaggaacatttggttttatttcacttaaaa      9660
ataaaaatgcagaccaccaatgttgtttggaagcattttgctgcaatcagctgtttgaacagctctgggg    9730
ccatgtgcggtgtgtttaaaaagtagcgctgccttccatacaaattaaaggaagactgtggcggggaaag    9800
gaggggaaaaatatatatatatataacacacagacatatatgcɢtatgtgtgagtttgtgagtgtacac    9870
atacacacacacatatatatgtacacacacacacatacatgcagtacaggggaaaaggagggaaaagg       9940
ccagggctggagatggcgaaagcaggaggacttctgcaaactgtgagcatgaaggcttttcttctctttt    10010
tctccccactccaaagccctcgtcttctttaagaaaaccaccactgcctggggtgcttcttttgggaggc    10080
tggggttgggggttggtgccattaaccagagagaaaaggggaaataaagcttggttggggttgcattatg    10150
agatttttttttcccttccttcatctcctggcctcggataagataaggcttgggggatgcacgaaataat    10220
ccaagtgattgattagacctggcatggcttggtttgggctggagaaagatcggggcgcgctggaaacccg    10290
cgtgaagatgaaatgactgtagctccgtgctgctcctccaaactcgggagcggtatccatgcaccccttt    10360
cccgtgtgtgtgggttacgacgtgggtgggagtggtgggcaagccgcaaaagtggggtagagctggttg    10430
ttttgcttcttcggaagcctttgagtgtggcctggaccttagatgggggtgcagggcggtttgccgctgc    10500
cacccctcggcaccatctctgaactgcccgcttttccggaggagcggaaaagttggaagccgaaaagacag    10570
gcgcccggagccctggtctaggtatcaggtgatccggagccctagtcggtgcccactaagaacaccccctt    10640
ctcccatcgggggttcggaggagtgttaagcctgcgggtctgccagtccctaaggtagggatggggggagg    10710
ggtgtgaggaatccgttccaataggcacaccatccctgctgactccccaaagaaaaaggcaaccaccacccgctcc    10780
ttcctcccgcaccatccatctcaaggctctctgtgacccgggccgatttcatctggtctcttctcccc        10850
cgcttccoacctcccaattcccgcgcagctcggctccgttccctcccactccctaggcggaactgaaag      10920
cgaagatcagccaagagcacagtcggaggcggcagagacggtggcgggtgagctaggggctgtgagacga    10990
agcaggagagagtgaacttcagccccgtccctcccactgccacggctggggcaaccaaccccgcgcc         11060
tgaagcggcttggcttgacctgcggaagcgccgggatggcgtggggagagggaggtaggtgccact             11130
gggctgcagatgacgagtgggttggggggcttgctgtgggacaagaggttcaggttccggcctgcgccttc       11200
cactccgcggtggcgctctctgcctgcggttttcaggaggccgatctaccccagggacactctcatcct      11270
tcaggcggtctcctggacgccctttcctcccccttgcctcccagcctgacctggctctttcgcccctcgga    11340
gaaccggtaggttggggtccctcggcggggtctagtgagccgagtcgcgagctttgcgccccgtatc         11410
taggccccgtgccgccgcaaatccggccaggcgtacagttctgtgagcctagtcgccgccagacacag        11480
ggccctttgtacccgaggagcgggagcgggagcgggggcgtcagggcaaccccttgcacccagaggcct      11550
gcctaggaccaccctgggaacaaatgtctcgctcggaaaacgaggtgaacccgaggatgtcctacgcat      11620
catacccctcccttcttgagaaggcttttctcttttttctttttttttccgttcttttttctctggc           11690
ttcttccacaccttaccgcaggtgtgggcctcttttcatgtatgtgcggctgctatctcggggatgcagg   11760
ggaaggcggtgtaggaggcagcgtggaǎgggtactaggagggtgcggcgggattttgggccttggatgt      11830
gcccgagcttgcagctagctggggcactgggcccccaagtcacgaattcagcccaggcgcttgggcagac    11900
tgcccggagcaaggacggaggatccagatttaccatttggacccaaattaagaaatttggggtgggggtt    11970
gggtaggggttttgaaactaagcaggtgacgtccttgcgagctgaatccacaaggtggtagtatgctta    12040
tattatttttatttttatttttatttttttttcattgttttttttgtgtgtggggagtggggg                  12110
atgttttttctctgtgtactccaatcttatgcttttttgaaggcatccattgcccgtaggggtttacataa    12180
gaccgcgttgcattatattttcttaaaagtgggggtggtgtgcataagcttccatttcagaatcagtcgct    12250
cctgtgatgtgagggaggcaaaagcaaagaaaagaaaaataaacaaataagaagtttagggagacttc        12320
attatcccacgaagccggaattgccagtttgtgtggtcgttctgcgggcaacatagaagtgcgtgtttc     12390
agaaatccttggatagcttctttcttctccaactagaaatttaaatggccagggtgcaaacacctgactttt    12460
gatgaaaacaaagtggcagaaactacaagagacctgattgcttcaatgaacgcactgagcctttcctca      12530
gaggatggcagagctgggagaaatcagatctcaaagaaatctacagttttgtgagggcagatttggagag    12600
tggagaattatttcatacctttagttggccctggtgaagatgttagcagtaatccatcaaatcctttagca    12670
tagattttcctgtggaaatgagcaaaatgttaaggggttgggggatggctatataggaatttcatggaga    12740
cctctgcaaggatgtattttctcagattagaaatccggtatttttattacacaatgtcaatgaatgcattct    12810
acacacacacatgcattccatatttctgtatgtgtgtctgtgtgtgtgtgtgtgtgtatgtagtct           12880
ttttaaagagtatctttgacatgtaaaaacataatcagggccattgtaggaagtggaaaattacttcatc    12950
agttttaaatcagtggattaaaatcggaggcttgattttgtgtgtgtgtgtgtgtgtaacactagaatga    13020
taattgcatattcataataatgtttgtgcttggataccatttaaagttgctttgatgttttctgctctg     13090
gtgaaagaattttcttttctttgtgttttatttaaataaactaattggtctcatatacagtaggcccctaaa    13160
accagtaacctagctgattttttacccaaacctaagaatataacagatacttggtaagggactagtggctg   13230
cataaggtagataattatgttatcttgatgctgtaaaatttacaagcagacttgaaggaatttgaaagtt   13300
cacagttttgggcctggaatgtagactaatggtaagcatacagatttgttttttaatttgtgaatttggct    13370
ttttcattttgtgtgtgtagtaatttgtggaaagcttatagtctctccacaaagacaggagcttttgac     13440
```

FIGURE 11A-3

```
tgactcgccatcagagaattgctttcacaagtgcagggGtctctttaaaatctctttggaatactgtgct      13510
tttatttctacaccacaaaaaggatctcacaaaagtaaacattcaagtgcatgaccgaatgaccttttt      13580
taaacattctttcattttaattggtactccacacttcaaacctttcctaaaactttgaatattgtcaata     13650
atgcaagttgctgagcgaatattgtgaatattgcattcaaatgaagtagcaatataaaaatattttaagt    13720
catttaatgtcctccttctgaagacaggcgtatgtggttaaaatatacttaaattccaaatatggtgaga    13790
gccggtcttaggatgtgaatgtcaagtttaagcaacacaattttagtttgtaaaccagaatgtattcttt   13860
ctatactactttctgatttttaacaatatgtattctattcctaaatgggaaaaatatgttcagttgagtt   13930
caaatccattgctgttttttgttttgtctgagtactacacttttttcagaggagagtcttcatctcctac   14000
ttaattatgtgaatggattttcagacagactgtgccttctgtatagccacctttattcttaaaccct     14070
gagctacaagttttaaatcaaagatacagcttttgcccagtcatttagagaaagtgagaatggaaattga    14140
agcccaggccattgaggcaattaggtcatctgctgtgccCtctgctaccattcagtcaatgaatatttta   14210
cagtttcatcattttaatctaaacaacctacatttggactttgaaaggctccactgttttttgttaagtg   14280
aatggcagtgtaggaaaccttcctcattttcttggggcagagtggcacacatgaatgagaaaaaaga     14350
aggcgatacctcctagcagtttgtcattgtgacattcataggctttgaataaatgtgtagatgaaaaggc   14420
cttctctctgcaggtgattacatgaaataaaaataagtaaataaaaggctcataaaaacactacaggag   14490
tggaaggttgatggtggaaaacagcctatctaccttgggttgagatttcaaacttttagacattttgtgtt  14560
gagttcacatgtccctgatgtatgggaacacctccatataccacatcttcccaaggcatgctcatcttc   14630
ccagaaatggtacctgaaggagagcaggcctaaccccaacaatatttttaaaaaactctctctatatatgt 14700
aactatatatatagagtaaaatctgtatcttactgtatattatatatatagtaatatatatttaata     14770
aggtttgtatttataaaggaaagaagtttaaatgactcgcagttcagcatggctggagaggcctcaagaa    14840
acttacaattatgggaaacgggaagcaaacacatccttcacaggatggcaggaaggagatgaatgagaac   14910
caagtgattcatggaaagccccttataaaacgatcagatcttgtgagaacttactatcatgagaatggca   14980
tggaggaaactgccctgtgattcaattatctcccaccacgtccctcccatgacacatgggattgtgga    15050
gccgcaattcaagatgaggtttgggtggggacacagtcaaatcatatcatgaggtttattatttaagac   15120
aggaaaagagtaatcgtccatactttagacgggagtgaagtacagtgaacattcatagtcccattggtt   15190
gaagaatacatttcgaagagagaaaatgttaatttcattatattgctaatgaaatgatctaggctttcact  15260
gctctctggaaatgtgagaagtggcccaggatcttgtttgggttgttctatttaaaatgtacattacat   15330
aaagaaatcatgatttgtcaaagtaacagagtggtatttttggcttacaatgggactttcttagctccac  15400
ctgttaatatcgatgatcattttggttttaagaggccagtatctgattggatgatgaaaacctggatctc  15470
aaagccatcacccagacatgtgatttattaacatctgtgggcatgtctcctggctcccacatcaaccc   15540
ttcatccaggctcattttctctgtttttgtttggttgtttgtatgcttTgggtgggGaaagggGacacat  15610
attttgctaagGgcacctttttcagtcatgaaacgtagcctgtcaataagctgaaaaggaacttgagttg  15680
tttcaagttgcattaggtagtaagtttttggatcctttaaaaaaaaaaaggactgaggttactaaaagtg  15750
ttattggcactgataaaagagccatggtgacttgtggttttgttttcacaaggtgtggaaaaggcctctt  15820
ggttctttgatgatggctgtagtgaagttgcatgcggtgccattttccatgtttagtattttcaacaacac 15890
caatatggctctgtggagtatgggacgggcaattccaagaactcagtgaggcatgccatgtgactccaat  15960
ggtcagtcagagctgttcagcatggaactatggtcccaaaagcatgggggatggggcagaagaaactca    16030
ttgcaactgagtgtctttaacttgttccagtcctcactactctctgtaatataactctgtgagtgggtt    16100
aggtgaggaaactcacaaaagtaaatgcgtgttttcacaaacaaatttatcattgttaactgttttcct  16170
aagtgagacaataatgccctcatgccctgaagctacactgtaagaatgcagtagtgctgtatgagcaggtgtat 16240
acacatacatgtgcacatatgccaacacactaactaggaactagtccttgcagaaaatgttttctcagc    16310
cattctaacacactagataaaagcaagtatgtgtgtgtgtatatatatacacacacatgtgcatac     16380
atgtataaacacatatatgtacatatatatatatatatatatatctgaaggaaaaatatcatttttca     16450
ttagttactttcctttttttattcccatcattcaccaaacctatgttatattaaacaatccataacaccct 16520
ggcctggacaatagagtgagacccctaactccacaaagaaacaaaaattaaaacaaagtagctggcacta  16590
ggcaagtacctgtggttccaactgaggtgggaggatcacttgaacataggagttcatggctgcagtgagc 16660
tataattacaccactgtactccagcctgagagacagagcaagacccctatctctaaaaaatatatataaat 16730
aaaacataaaaaataaaaatagaaaatttacaatgaaaggtgtaaagttacctatgatgggcctgggtgt  16800
aatcttcatttaggagtgaatatattcattaaagtgagacctaagtagtataaagtatgtgtttagggac  16870
aggtgcccattttctctaggtctcctggaatattttttttctaaattgagttctgattccaaaaaggtg   16940
ttattgcctatgcttatggtgaaactatatgtgtgacaaaatgctactctgtcttgtccatcaatattgt  17010
gcaatgtggtattcttcatggagcaattgacaacttttacagtgatcaaactgggcactcttactaag    17080
gctaaattcataaccctttttatctgactttgtagaagattctccaccttatttctctcggtgcccaaagg 17150
ctggcctgagagactgttcccattgaagccttaacagaaagcttgtagagcattgtaacagcccagcttca 17220
gaaacccagcattgactttcaataaatatgaaggagtttgaagtcacaaatgttgagaacctcattatag  17290
tctctttatgaacttgagtccctctcttcctgcagaCttcctttgaactcaaatttaatgtgcactactt  17360
attcaccccttgtacttatggaaaagcattgacaatcccaggtaataactagagaagaaGtgagtgaatgc  17430
tagagggtttctcatttaggttgttcactcaccactgtgcacaggctcttagaaatctacttacaCatg  17500
atgagactgtaagcagactctatgtttctgaagcatcagtatacaggtgtgcagaaagaaatgggctaggt 17570
cacttaacagctacgagtataactaagatggacaaaatagtttatttgcagattatatctatagagcct    17640
tcatcatctatatctatatctatatataaaatagggtgcatataaacatacacagatcatagattattca  17710
tttcagtttctacatacaatatgtaatttatatacaattgcatttatgtgcatttatataatagtatttg  17780
tatacaacttctatacttgaataaaaactgtcatcttcaatagctgtttaatatatatttattctcagata 17850
gttgtatttatgtacatttacataattgtatttatatacagtttatattactgatgaaagcctttatcac  17920
ttgcaaacttacttatacaaaatacaatttatctaaacataaaatgtattatataaatataagttatata  17990
ttaatatatagcatatacaataagtcataaatatataataaaaatgtgttttgtatacttatttattata  18060
tattgagtataactcattTaaatacaattttatattataatgtattatatattgtgtaataaatata    18130
atttatatattgctattatatataccctattgtatataagatataataaaaatccatctaaatctataataa 18200
aatatgtatatatttatgttctgtatatgtattttctttgcttttatgtattaaaaatacatacaaact   18270
atatatgtagtatactgcaaactatatatatagacatgcattttccaaaagaaactgtgttataggtggt  18340
gagtgaacttctaggctgattcacaggagctatggttactatgcgtagtggtccatggaaactacaactt  18410
tacttcaagtggagcataagagctataaatgactgtaatatgatagcAagcacatcatggcactctgtg   18480
aatcctgagaaatcgacctttcgtgtgttttgtgaaccagtcaggaaagctcatttgagtgggaggatgt  18550
```

FIGURE 11A-4

```
gtcaagccatgtgtctctcccaccgagatggatagacaacatctgcttatagactgagaaactacctgag    18620
gttgtgtggaagtcatgacaaattggcaatgtcctcagtgtgttcggggtgggaggtggtgatgtccctg    18690
gacctatgcttagcttttatccctctgtgggaccaattctgttggcaaaatcacttctgtggtcttgctc    18760
cagatgaaaaatcaacatggaaggcttaggggtttagtgctctagttaatggcaagaaagaaaatcagtg    18830
actaagatcaatttatcctttgtgcaaaacagcttttttattggaggagctaggtcttatatagagcta    18900
gctcttatatagagcaggagctagctcttatatagagccacctagtatgttctttcatttgtcattttta    18970
ttgatcatctactatatgccagatacaggccagaaagcaaattctgagctggtaatggagaggcaaaata    19040
ggccatccctgtactctaaaaaatcctgcctatgtgtggatgttcacaagaacgttgttaagattttag    19110
ttcaggtatggattactttctttcattttgttgtatacattacattttttttctttcatcctcatacct    19180
ctctccttcccttccttccttcttcccttacttccctccctccttccttcttttttctctattttccttcc    19250
ttttttctctccctccttccctccctccatcctccttccttccttccttccttccttcctttcctttct    19320
tcttccctctttccttatgctctatttggatgagtgataaaatctcaagggtccttaaaatattaaaggga    19390
aaatgaagataattctattgaagaacagatcaaataggaaagagtaatgaaaagaaagcttcctggaatg    19460
agaaattagcatgttcttttacaatttaatagaattttttcatatactatatttgtatagctggttagattt    19530
taaaactttgtcaaacccctacatttataaaaccttagttttcattttagtaagttatatggatgaatgca    19600
cacataaagcagattaccttgattcaacaaaaacattcaaatattaggtgatccttttttttaacatatg    19670
gtagtggaaacagcttgattaattttatggctatttcctacatactttttaaaatcaataagcaacagtca    19740
gatatttcagcatttttaaggcatgaacagtaccttgaattgtaatatattttagtctaaaacatctggt    19810
aacatcacaggtaattgcttcaaactctactgccgctcatataatttactttttcatcaatttaaggtc    19880
ttttagagtcatgagaggacctttaaaatagataacatcactcatactattgagctaggattgcttaaag    19950
atggagcatagattacattgtctcagaggaaaatatcttttttttttgtgtgtgttct    20020
tggatacatgtgcagaatgtgcaggtttgtgatagagttatacatgtgccatggtggtttgctggaccta    20090
tcaaccagccatctaggttttaagccccacatgcattatgtatttgtcctagagctttgcctcccccttt    20160
ctcccacccctgcaccaggcccagtgtgtgaaattcacctccctgtgtccctgtattccattgttcaga    20230
ttggacttatatgagaacatgtggtgctggttttcggttcctctgttagtttgctgagaatgatggtttc    20300
cagcttcatcacgttcatggaaaggacatgaactcattcatttcatggctgcttagtattccatggtgt    20370
atttgtgccacatttttttctatccagtctatcactgatggtcatttagtttggttccaagtctttgcta    20440
ttgtaaacagtgctgcagtaaccatacatgtgtatgcgtctttatagtagaatgatttataatcctttag    20510
gtatatacgcagtaatgggatggctgagtcatatggtatttatggttctagatccctgaggaatctccac    20580
acactcttctgcaatggttgaactgattcatagccaacaaacatgtgaaaaaaagctcatcatcactggt    20650
cattagagaaatgcaaatgattctttaaaaagtataagaactcccgaatcaggtattctatcttgaagag    20720
gctccctggtccaatattctggaaaaacctcatgtatcatttgcctctcttgaatttaccctgaagaca    20790
gacacattatgccttaaagcctcctatactaatggatttagcaggcataccaaataacttaaggttggt    20860
tctttgtaatgaattttaatcaaattaactacctaacagtattcagaatacttccattgacacagagcag    20930
aaagaagtgccaacaggatatgaagtatctttaaattaccaaaataatttggagaaatgaacttgttgat    21000
tttttcttttattttatttacttattcaaaacttgttgagtgccaagaagtgggataaaaatacaatgaaa    21070
ttgtttattttttcctatattaacgataggctaatattattttgcacctctggtcttactggtcttatgtt    21140
tgagaacaaataagtttttatctgaatattttatctctcgtgtgtgtgtgtgtgtgtgtgtgtgt    21210
gtgtgtttaatctctcatgtcctgtcaaaaattaagaaaaagaacagtttgattcagtcttcacacatct    21280
ttcttaaacagttaaaggcaaaatcatcagagctacatgcccaaatattagcaggtaggttcatgtttg    21350
aattctcagagggtgattatgtagttcaattttaactccttcaacagacagactactatcgttgatgagc    21420
aaggagacaaaagtatttgataaacattatgtagttaatattatccttgagggaggggagaaggctgcct    21490
gtcttaggtaatgctttcgatggcaggtttgtcctaggcttgaggtagcaggcttgctcttttggctgaa    21560
gaagcccctaacatgcataccagtattgcaaatttacccacatgccaattgtatgctgtggaagaaatga    21630
ataatgtagatccctatacagagaatgatgtgtgaacagatagacttaatgcatcagaaccagtgagcagt    21700
agacaagacattagaaaataacaacagcagtgaaaacaaatataaacaaaccacaaacaaaaccattac    21770
atttgggtttctggttgcctgttacctcagagggtctggttacaagctaaaatgtcttgaccattagga    21840
aggtcaagacaaggcccttaatgctgtgtaaaacagtaacaaacagtaagggtgacccaggagagaaggg    21910
taacaagttaagttaaataccagggagaaagtgtagcagttacattggaaattaaataccagtta    21980
cctgtgcagagactgaaaatacaaagcagacacaggaacggtagtagtagaaggcctagggcaagggatt    22050
ggcgggcgggggttgggggggatggggcgggaatctgaatttgatctgaatttgttgcagcttgaaattg    22120
cagcttgaaactagccagccaactctaatgagggcattgatatgggaaaaacactacctcagaaaaaaaa    22190
tctgacaacctaggtagagatcaaatggtaccatattctgaggatggaataataattcacacatggcttc    22260
acataaaatttgtgtgacaatggttatttactatgtcagtctgccatggcaatttttaccagtaaaata    22330
actttctaggatttatttgatatcagttaataagcctacctaaatgaataaccagaatatgacaattga    22400
aaattaatgtaaaattacacaaatagttatgtgtctagatatttcacaatcaaatgtatgtgggcattta    22470
atctagtcagatccaaataataaaaaattctttctttctagaccaacatttatcttgatattatacatac    22540
atatgtaaattacaaccacatatttgcatatgtaaattacacagcaatttacactagatacatacatag    22610
ctcactttttgttggtgaacacattttcctgaaggttttttttttttttttttttttttttttgagatg    22680
gagtctcgctctttcaccgaggctggagtgcagtggtgctatctcggctcactgcaagctccgcctcccg    22750
ggttcatgccattctcctgcctcagcctcctgagtagctgggactacaggcgcccaccacgcgcccggc    22820
taattttttgtattttttagcagagacgggggtttcaccacgttagccaggatggtctcgatctcctgacc    22890
tcgtgatccgcccgcctcccaaagtgctgggattacaggcgtgagccaccgcaccagccgaag    22960
gttttaaaataataattattctacctgtaatgccatagcagtattggtaaaaagttcaaatgtggctgg    23030
gtggagtgcctcattcctgtaattctagcatttggaaggccaacacaggagcattacttgagtccagca    23100
ctttgagagcagcctggaaaacccctatatgtacagaaaataaaaaaaaataaaaaatagagtaagccag    23170
gtgtgggtggtgcatgtctgtatccctgctactcaggaggctgaggtataaggatcacttgaggagttta    23240
tcagtagtttgaggctgcagtaggcctatgacctcaccactgcattgcaacctgggcaacagactgacacc    23310
ctgtctttaaaaagaattcaattgcatcatttatgtggacagatttgactggtgtcattctgttgctga    23380
atcattccaaggtatgcacttacctttctctcttgaaacagctcatgcaaaaacaaacaactaaataga    23450
gaagcagtttgcaaaactatatttaaaggtaaaccatactccctcacccccaactccacaaaaatagttt    23520
tatgtagagaaaccacagatggtgcagccccaaatctggagcatcctcaggtaccttggggtattctgg    23590
agtgaaagactaaatctcagaggcttttggtcacacttgggtaggcatcctgattggctagtgaagaaac    23660
```

```
agctgtccctgctgtggtcagtttcagccttcctggaagggaattttccagcattgggtgttcctgtag   23730
atgcttatagcaagttatgttcaatgaagccaactgcatcctgatttatctgttattcaatctgtgctgc   23800
ataataaaaaaggtctgctttgaaaatgaaatcatgcactttgctttattttgcccatttgatatttctt   23870
ctaatgttgtaagcttctcatgaattggcataagcagatatgttacaaattgatccatccaggacatcct   23940
tgctagtcttagctcaccatagcaagtcagaatggaagacagttgcttctcctccctcctctccccatc   24010
ccacctcacatctgacatccttctcctctgaggaaaaataatcctctgttcaaatttaaaagcatggcct   24080
ggtatgatggctcatgtctgtaatctcagcactttgagaagccaaggcgagcagatcactggaggtcagg   24150
tattcagtcagtgatacactctctatactaaaaatatgcaaattagccaggtgtggtgtcatgcacctgt   24220
agtcccatctacttgggaggctgaggcaggagacttgcttgcacctgggaggtagaggttacagtgggct   24290
aatatcatgccactggactccagcctaggcaacagagtgagtctctgaaaaaaagaaaaaaaatatagaaa  24360
aatgttcaagtatttactgtccacatctttcagctatttaacacttcactgggattgtgaagtgaaatgg   24430
agtgccattattaccttgttagccactttcaatttggaaaggtaaaaatgtccttcaatgctattgaac   24500
tgcctgcactgaatttaaagtacagtttgttggaatattcgtgatgaagttgaaaaatagaattacagat   24570
tattaggacttgaatgtacttgaggaatcatttgtattccctcatgtacacaaggaaatggagtcacaga   24640
aagtttcagggatttatccccatactttttaaacactgaaatgttcccaaaatgaaatgaaatacttccaa   24710
ttgttaacatatccgcttatgtcaattcatgacaagcttacaaaattagaagaaacatcaaatgggcaaa   24780
ataatgtgaagtgcatgatttcattttcaaaacagactttttattatgcagcagagatcgaataagaga   24850
taaatcattttgatgaaaggaacaatgagagaaagcaaagaaagacatgtcctgcattaaaagctgcatt   24920
tgatggtaacttcattttgtttttatgagttatgatgaatgcatctgctgtttctaacctccctcccatt   24990
ccctattttatttgtcagttaaagcacagcattttccctttttttttgaagtgttaattaattgcatt   25060
tgtttaatgcatcttgctgtgtctcaagcatggttaacaagggataatgcctttttcagggatgattcc   25130
ttccttccttacggggctttgtctgtgatgggaactttgtgttttatttatttattttcttttaagag   25200
acagggtctaatcaggttgcacaggctggtctcaaactcctgggctcaagggatccttctgactgacctc   25270
ttgaaacattgggattacaggcgtgagccaccgcacttggctctatctttctgcaaaaacctagcaattc   25340
taattctctctccatctatgtctagaccagggagatataatcaagagaaaagaaacaactaccttcatta   25410
gattaagagtcaaaagggcctacaggcaaaaagactccaggaccctcttgagtgagcctgtgcattgaaa   25480
tcttcagcttcatagagacacagaagtccaaataggaagttggatttgccctatttctcttagcctcttct   25550
agtctgtgaccgtttcttcctttgttttttcatgaccttaatagttttttggtattaatattatg       25620
gagaatgtccaccacctgggtctgtctgatgttttagacagggatatgtgttttggggaggaaatctgc   25690
agagatgaatcaatcatttatatcactatgggcacatggatgttttggatatgctttaggttttaattca   25760
acactacactactgtgacttgctctactttatattctttgtggccatgatgagacactaaaacatctatt   25830
cacttgaatagcaagtaaatgagaggactcaatggcaaatgactgttatgctttaacatatccagttctt   25900
tgtatattttttgacattttaggttattttaatgccttctcctctaaggtatttcctttcttcttttttt   25970
tttttttttgctccacaccctccctcctctaacttgtttccaaattcttccttgtaaattgtgcattcc   26040
tcattctaggggcattacttattttcttttgcttgcttcaaaaaacactctgcattggtctgtacacatt   26110
ttccctcttatatcctttctgtaagcatttgtattcagttgaaatcttatgaatactttaccacagaaa   26180
atttctggtgtataccaaaaaagggaatgaaaatagaataatggatcccatttgcccatcatttgcttca   26250
gcaattataaatgcatagcataatctttagtatttaacctcatttatgtttccattcttattatggcatg   26320
atgcaatttatttaaagatagtttggtgagaaccattcactcccctggaaaggaggctgaagcccaaaag   26390
tcaaagtggtgtggctcggtgggtcccatcccactgagtccggcaagccaagatccactggcttgaaat   26460
ctcgctgccagcacagcagtcttaggtcaacctgggacactccagcttggtgtgtgtgtgtgtgtgtgtg   26530
tgtggtggggggcggggggggcacatccaccattgccaaggcttgagttggcagtttttaccccccagt   26600
tgtaaagaaagccgcctggcagttcaaactggtcagagctctccacagctcatcaaggccactgtggcaa   26670
gactgcccctctagattcttcttctctggtcagggcatctctaaaaaaaaggcagcagctcagtcaggca   26740
catatagttaaaaccccctatctccctgggacagagcaactggggaaagggcagctgtgggtcagcttc   26810
agcagacttaaacgtccctccctgatggctctgaagagagcaaaggatctcccagcacagtgttcaagct   26880
ctgctaagggtcagactgcctcctcaaatgggtctctgaaacttgtgtatcctgactgggacacaccacc   26950
cagcggggggccaacggacacctcatacaggagagctcttgctggcatctggctggtgccctctgggaca   27020
aaactttagaggaaggagcaggcagcaatctttgctgctctgcagcctccactggtgataccaaggcaa   27090
acagggtgtgggatgaacctggagcaatctccagcagaactgcagcagaggggcctgttagaatgagaac   27160
taacaaacagaaaggaatagcacatccactcagaggcccatctgaaggtcaccaactcaaaaaacaaa   27230
ggtagatgaatccatgaagtggagagaaaccagtgtgtaaaaggctgaaaattccaaaaaccagaatgcct   27300
ctcctcctccaaaggatcacaactcctcacaagcaagggaacaaaactggatggagaatgagbttgatga   27370
attgacagaagtgggcttcagaacgtgggtaatagcaaattcctctgagctaaagaagcatgttctaacc   27440
caatgccaggaagctaagaaccttgaagaaaggttagatgaatttctaactagaataaccagattagaga   27510
agaacataaatgacctgatggagctgaaaaacacagcatgagactgagaacttcatgaagcttacacaaatatcaa   27580
tagctgaattgatcaagtggaagaaaggatatcagagactgaagatcaactcaatgaaataaagcaagaa   27650
gataagattagagaaaaagaatgaaaagcaacgaacaaagcctccaagaaatgtgggactttgtgaaaa   27720
gaccaaatttaagttgaagtggtgtacctgaaagtgacggggagaatggaaccaagttgaaaaacactct   27790
tcaggatgttatcaaggagaacttccccaacctagcaaggcaagccaacattaaaattcaggatatacag   27860
acaacaccacaaagatactctccagaagagcaacaccaagatacataatcatcagattccacaaaggttg   27930
aaatgaaggaaaaaatgttatgggcagccagagagaaaggtcatgttacccacaaagggaagcctgtaag   28000
gctaatagcacatctctcttcagaaacactgcaagccagaagagagtgggggccagtattcaacattctt   28070
aaagaaaagaattttcaacccagaatttcatatctagccaaactaagcttcataagggaaggagaaatac   28140
aatcctttacagacaagcaaatgctgagagattttgtcactatcaggcctgcgttactggtgctcctgaa   28210
ggaatcagtaaatatggaaagaacaactggtaccagtcactgcaaaaacatatcaaattgtaaagaccat   28280
tgacactatgaagaaactgcatcaaataatgtgcaaaataaccagctagcatcataataacaggatcaaa   28350
ttcatacataacaatattaaccttaaatgtaaatgggctaaaagctccaatcaaaaggcacagactggca   28420
aataggctaaagcgttaacactcattggtgagctctattcaggagactcatctcatgcaaagacatacat   28490
aggcccaaagtaaggagtgggaatatttaccaagcaaatggaaagcaaaataaaaaagcaggggttg   28560
caatcctagtctctgataaaactcactttaaatcaacaaagatctagagactaggacattacataatggt   28630
aaagggatcaatgcaagaagaagagctaactatcctaaatacatatgccctagtacaggagcacacaga   28700
ttcataaaacaagttcttagagacctacaatgagacttagaatgccacacagtaatagtgggagacttta   28770
```

FIGURE 11A-6

```
acaccccactgtcaatattagactgaacaatgagacagaaaattagcaaggatattcaggacttgaactc    28840
cgctctggatcaagttagatcaagtggacctaacagacatctatagaagtctacatctcaaatcaacaga    28910
atatacattcctctcagcacttcatctcaattcttctaaaattgaccacataattggaagcaaagcactc    28980
ctcagcaaatgcaaatgaatggaagtcataacaaacagtctctcagactgcagtgcaatcaaattagaac    29050
tcaggattataaatcattctactataaagacacatgcacacatatatgtattgcggcactattcacaata    29120
gcacaggcttggaaccaacccaaatgcccatcagtgatgatagataaagaaaatgtggcacatgtaca     29190
ccatagaatactacacagccataaaaaggatgagtTcatgtcctttgcagggacttgggtgaagccggaa    29260
gccatcattcttagcaaactaacaaagggacagaaaaccaaacaccacatgttcccactcataagtgcaa    29330
gttgaacaatgagaacacatggacacagggaggggaacatcacataccagggcctgtggtgggggtgggg    29400
ggcaaggatactattaagagaaatacctcatctagatgactagatgacgagctaatggatgcagcaaacc    29470
actatgtcatgtatatacctatgtaacaaacctgcacgttctgcatatgtaccccagaatgtagagtata    29540
cataaaaaagatctttcagtacattgctgtaaaatataggaaccattttattttatttagctgcagaatc    29610
ttttccatgcctaaaattatcaacaataattcctctatgtcaccaactatcaaattataaatgtcaaaat    29680
aatattttcatagtttgctaactcacacaaggtctatgcactacaatcagttgatttgtcttttacattt    29750
cttttaactgatatagatttcttatcctttatgcacattcttgttggaaaaaactgctcttttttactct    29820
acatgaaaatgggtttagagtcggaaaatttagctgtcaagttattttagaaggaacgtgagtattttc     29890
cataatgctcagtcttaggttaccaactccttaggagcaaatgctgtgtgacttggtagtgatctaccca    29960
gaaggaatgctgctgggtaaatttggccagctgtgtgacagctctttggactcactatgtctcagtttc    30030
atctactttttaacagtgttttattttgaagatagtttctgactctgtcacccatgctggagtgcagtgat    30100
gcaatcatagctcgatgcagccttgaacttctgggctctagaagtcttcccacatcagcctcatattatc    30170
tagtacctggcagagatacagatctgatgagaaacaaagataaagggggtgtcagaaggtagcttttgctg    30240
catcatcagacacgcacacatgcgcacacacacgtgcatgcatacacacatgtgtacgcacacacaatca    30310
actgcaatttttcctctttaccaacccacagttagctgaaattatcattagggtatttctaggttatat    30380
gtgcacacacaacctacttaagttctgagctcaatattctgttttattctttcctgttcagaagccagca    30450
tccatagctctgggtctcattatttgcttttgtcgtccagttgtgctctactgatttaaaagttatctt     30520
tacattttcagtttcccagtcaattcaagccaaagcatatttattgggcatctaccatgtgctatggact    30590
gtgagagacttaaagattaataacaacaaccataaaaactcattgatatgctgggcattatttctctccc    30660
catggcctccaaatgcttggcccataattcaaaacactacagcaacttgaaggcagcagattgtttctca    30730
tttcagggatccacaggtttatgccttctcaaacaaaggtctggtaattccaggctgcatgcagctattc    30800
ttccttaaagactgagaaaccatgcatacaacatcttttcctttcctcgtttatacaattgataatt     30870
acatattgacatcttactttgagaaagtcgtcatactggataccgtcagtcatagaaacagagataagat    30940
tcaacctctgatcccaaggaaggcagactcttagtaaggaagtcaaaacaatataatgaaaatgccatac    31010
tgcaaggcatgcacatcatacattccataagtgggtaaaaacatgccttggcagcacagaatcttgcttt    31080
ccatttgtgtcattgaggacagtgcattagttatctattgctgcataaaaaattcctctaaactttaggt    31150
taaaaccgcaaacattttttttcctcgtgcaatttcttttttttttttttattataactttaagttta    31220
gggtacatttgcacattgtgcaggttagttacatatgtatacatgtgccatgctggtgcactgcacccac    31290
taactcctcatctagcattaggtatatctcccgatgctatccctcccccttcccccacccacaacagt     31360
cccagagtgtgatattccccttcctgtgtacatgtgatctcactgttcaattcccacctatgagtgaga    31430
atatgcggtgtttggtttttgttcttgcgatagtttactgagaatgatgattccaatttcatccatgt     31500
cgctacaaaggacatgaactcatcgttttttatggctgcatagtattccatggtgtatatgtgccacagt    31570
ttcttaatccagtctatcattgttggacatttgggttggttccaagtctttgctattgtgaataatgcca    31640
caataaacatacctgtgcatgtgtcttatagcagcatgatttatagtcctttgggtatatacccagtaa    31710
tgagatggctgggtcgaatggtatttccagttctagatccctgaggaatcaccacactgacttccacaat    31780
ggttgaactagtttacagtccaccaacagtgtaaaagtgttcctattctccacatcctctccagcacc     31850
tgtgtgtttcctgacttttttaatgattgccattctatctggtgtgagatgtatctcattgtggttttgat    31920
ttgcatttctctgatggccagtgatgatgagcatttttcatgtgtttttggctgcataaatgtcttct    31990
tttgagaagtgtctgttcgtgtccttcgcccacttttgatggggttgtttgttttttcttgtcaattt     32060
gtttgagttcattgtagattcggatattagcccttgtcagatgagtaggttgcaaaaatttttctcccat    32130
tttgtaggttgcctgttcactctgatggtagtttcttttcgtttaattagat    32200
cccatttgtcaattttggctttgttcccattgttttcagtgttttagacatgaagtccttgagcctatg    32270
tactgaatggtatggcctaggattcttctagggtttttatggttttaggtctaacattaggtctttaa    32340
tccatcttgaattaattttttgtataagtgtataaggaagggatctaattcagctttctacatatggctag    32410
ccagttttcccagcaccattttattaaataggaatccttctcccctttcttgtgtttgtcaggttttgtca    32480
aagatcagatagttgtatatatgcggcattatttctgacggctctgttctgttccattggtttatatctc    32550
tgtttttggtaccagtaccatgctgttttggttactgtagccttgtagtatagtttgaagtcaggtagcat    32620
gatgtctgcagctttgttcttttggcttaggattgactaggcaatgcagggtctttttggttccatatg    32690
aactttaaagtagttttttccaactctgtgaagaaagtcattggtagcttgatggggatggcattgaatc    32760
tataaattaccttggacagtatggccattttcacgatattgattcttcctacccatgagcatggaatgtt    32830
cttccatttgtttatatcctcttttatttcattgagcagtggtttgtagttctccttgaagaggtcattc    32900
acatcccttgtaagtgggattcctaggtattttattctctttgaagctattgtgaatgggagttcattca    32970
tgatttggctctctgtttgtctgttattggtataagaatgcttttgattttttgcacagtgattttgtatc    33040
ctgagacattgctgaagttgcctatgagtttaaggagattttgggctgaggatgatggcgttttctagat    33110
atacaatcatgtcatctgcaaacaggaacaatttgacttcctcctaatcggatacctttattttc    33180
cttctcctgcctaattgccctggccaggacttccaacactatgttcagtaggagtgatgagagagggcat    33250
cccagtcttgtgccagtttccaaagggaatgcttccagttttttgcccattcagtatgatattggctgtgg    33320
gtttgtcatagatatctcttattattttgagataggtcccatcaacacctaatttattgagagtttttag    33390
cgtgaagagttgttgaattttgtcaaaggcttttctgcatctattgagataatcgtgtggtttttgtct    33460
ttgcttaaaactgcaaacatttattatctcatacatttcgttcttcaggattcaggagcaatgtag     33530
ctggccagttctagctcaggatctctcatcatttgtaatgaaattgtagacagggcttgcagttttatg    33600
atggtgtgagagaatctcacttatgtgtgctgggcaggaggcttcagttcttggccacattggcttctcc    33670
ctagggctatacatgagaccttaacagctggcttttctgaaagtgaggagagaaagaaggaggctaaaag    33740
ggagtctaatatgaaagccacacactcttagaacttgatcttggaggtgacaccttgtcgcttttgcact    33810
agatttggaggtgaaaccttgtaacccagaaggtgttaattgtaggtgtcaattggccatcttggaagc    33880
```

FIGURE 11A-7

```
tagactatcacagaagctcttccaaaggaggtagcttaggagctgcatagaatttgtcataaggacaaa      33950
ggagaaactgtgaacaaacacataggtacagcaagtgttgaggatgggctgtgttgtgttcagtgttatc    34020
ttaagggttgagcttctgtgatgaaattgaaatcagatcatttcaggtggtgcaacttgctggtaagcca    34090
tggatgttattctgtaggcaatggatgaatcatagcaggactttgcagaattattaaagaatatcagttt    34160
catgatagtagaggttgggatagaatacagaagattagtggtgcgagttgagatctacttatagattcaa    34230
ctgggttagagattgaggaaatggggaaggaatgaggctctgcagaggcattggaaggatgatactgata    34300
gaaatttgcaaaccgttagaggccaagacaagaaataaccatccaaagttgcagttataggtaaaactgt   34370
ccaattaagagaaagagaaagagttcagaggtgggtgaaggtcaagattattagatgctttggagatcctt  34440
gggactgacggatatgttatttattattttcttggtgattataaggtaattaatagaaatttagagatta   34510
ttgtttttccatattttcttgtttggagggcatttttttttaacctgaaattggcatttccttttttacctg 34580
aaacatatccattatccagacagtttcagtgaggcacggtggccaaagtaggaggatgacctgagttcag   34650
gagttggagaccagcctgggcaacatggcaaaatgcatctctacaaaaaatataaaaattacccaggcat   34720
gacagtgtacacctgtagttccagctgtgtggtaggctgagattggaggatcagttgagcctggaatgca   34790
gaggctgcagtgatcccagatcatgctattacactccagctgggtgacagagcaagaccctgtgtcaaa    34860
acagaacaaaacaaacaacacacacaaaacaaaacacaaaacacaaaacaaaaacaataaaactttcttaa  34930
ccattctaacctaattataattctaagacctatctgtgtcctgacctcaagagcaggtacaattattgaa   35000
aaacatttctttaattattcccagttctcttacaccttttttttctcacaataggcagcatcccctcag   35070
ttgtccagctgaccactggaagggctgatacctcaggaaacacataccctgctaggagattctccatagg  35140
ccctgacttgtttattgccctgctttaggtagctttctcttcctcacattctgttctcctaattttctt   35210
ccactgcctaataattgaactgactttctgactgtctgttcctcctgcctttgcagttattgtaactcc   35280
ataaatgccacccttgagtcacttctcttccttccttcctactgtctctcttactggcctatgtagcctt  35350
gcatctactcatggtttgatgataatttccttggagagaccccaggggcctatacgttctgccctcact   35420
tcccctccaagtttcttcctgcccttatagctccccttgaacaacattgcctatatgttctgcccaaaa   35490
ctcaattcagtgttcccaaaattgtctcgtcatcttcccaagcttacccggctccctgctcatagcatct  35560
cctctcagtccctatcttgggtttgaatcccctctcttcccatcccaatgtaaatcacttcagaaa      35630
taacagttacttccatttcttcttctgtgatacatctctaatttccttggtcatatgctccctttttctg  35700
ttactattttaatcatatcctgtctatgacttgtacactctctaatctattttaaagctattcttcatc   35770
ttcctatataattgattgtgtaagactatctcattcaaaattcatcaacaagtgtccactgtgctacacg  35840
acctgcccatctccatcgtcacaacgacagtcatcatttctttcctctggatggtatacttcatcttcc   35910
atccaacctgagtttacctaggaatcactgcatttcaccttggtttcttgcttttctcattcttttca    35980
ggctctcttcaacttggaatactgctactattccatctccacacaatttattcattactgagggctaaaa  36050
tgctgtttcttgcacttctctcccagtttcctcgttctgcagaactaattttactgattcctctctcatca 36120
gggacagttccttttccaaaatcctacaacgtgggtccatgaaatcagctagagaaaaagagggacaggat 36190
ggaggctaggattatcatgggcactgacatactggcctctggggttaggaagactaataactccctaggaa 36260
ggaaggaaaagaaccttggagaggactgttttatctcagtatttcccagaagctccaacagtggagactt  36330
ccctgggaccttcacccatctgctcctaatgagcttcctgcctgtggggctccactcagaacgttacat   36400
ccggtgatgcataggacaccatttgcagaaatgtgtgcatgcgtcctggcgtgtgcgtgcttcctggcgt  36470
gtgcgtgcttcctggcgtgtgcgtgcttcctggcatgtaagtgcatgtggcacatgtggcatttactgagc 36540
atgcatgcattgatgtgagaatgtatttcttccttttccacgatgaactgccacagaatggttaaagttt  36610
ttcagggctgaaaaggttgttttagcttgaatatgcacaaatatgttttattgcagcaactatttaaaa   36680
tagctctgaaagccattatttttcccattccttcttcccccaaaatttgactctttatccaatttttcca  36750
ttctgtgtcttttaattggggcatttagcctgtttacatttaaggttattattgttatgtgtgatttgat  36820
cctgtcattattatgttagctggttattttgcacattagttgatacagtttcttcatagcaaccttggtc  36890
tttaccatttggtatgttttggcagtggctggtgccggttgttccttccgtatttagtccttccttcagg  36960
agctcctgtaaggcaggcctatgttgacaaaatccctcagcctttgcttgtccataaaggatttttattc  37030
tcctttgcatatgaagcttagctttgctggatatgaaattctgggttgaaaatccttttctctaaaaatg  37100
ttgaatattggcctccactctctttttgattgtaggggtttctgaggaaagatccactgttagtctgatgg 37170
gcttctctttatgggtaaccccgagctttctctctggctgcccttaacatctttccttcatttcaacctttt 37240
gtgaatgactattatgtatcttggggttgcttttctcgaggagtatctttgtggtgttccttatatttcc  37310
tgaatgtgaatgttgacctgttttgctaggttgggggagttctcctggataatatcctgaagagtgtttt  37380
ccagcttggttccattcttcctataactttcagatataccagtcaaacataggtttgctctttttacata  37450
gtcctgtctcacgtgcagaaatacacatacactcaaaataaagggatggaggactatttagcaagcaaat  37520
ggaaagaaaagaaaggagggcttttcaatcctagtctctgataaaacagacttttaaccaacaaagatcaaa 37590
gaagacaaagaagggcattacataatggtaaagggatcaatgcaacaagaatagctaactgtcttaaata  37660
tatatgcgcccaacataggagcatctagattcataaagcaagttcttacacctacaaagagacctagact  37730
cccacacaataatagtgggagatttaacatcccactgtcaatattagacagatcaatgagacagaaaac   37800
aaggatatcaggacttgaactcaactcgtgatgaagtggacataagacctctacagaacttccaccc     37870
taaatcaacaaaatatacattcttctcagcaccacatcacacttattctaaaatggaccatataattgga  37940
agtaaaaaactcctcagaaaatacaaaagaatgtaaatcataacaaacagcctgtcagacacacgtgtga  38010
tcaaattagactcaagattaagaaacttactcaaaactgcacaactacgtggaaactgaacaacctgctc  38080
ctgattgactactgggtaaataatgaaatgaagtcagaaataaagaagttctttgaaatcactgagaaca  38150
aacacacaacatattagatctctgggaccccagccaacagtgtttaggtggaaatttataacactaaat   38220
gcccacaggagaaatgggagaagatctaaaaccgacacactaacatcacagttgaaagaactggaaaaa   38290
caagagcaaacaaattgcaaagctagcagtaaacaagaaacaactaagattgtagcagagcagaaggaaa  38360
gagatacagaaaaaccctttcaaaaaatcagtgaatccaggagctggttttctgaagattaataaaatagg 38430
tggaccactagcaagactactaaagaagaaattcagaagataaaataggacacacaaaaaatttatacat  38500
ggcgtatcaccactgatcccacagaaaacacaggtaccatcagagaatactataaacatctctatgaaat  38570
aaacaaggaaatctagaagaaatggataaattcctggacacatacatcttcccaggactaaaccaggaag  38640
aagtcaaatctctgaatagaccaataacaagttctgaatttgatgctgtaattaatagcctatcaactaa  38710
aaaaagcacaggaccagaaggattcacagctgaattccaccagaggtacaaagaatagctggtaccattc  38780
cttttgaaactattcacaacaacagaaaaagagggaaccctccctaactcattttatgaggctggcatca  38850
tcctgataccacaacctggcagagacaacagaaaaataaaatttcagacaaatatccctgatgaacat    38920
tggtgtgaaattttcaataaaaatactggcaaagagaatccagcagcacatcaaaaagtttatataccac  38990
```

FIGURE 11A-8

```
gattgagtcgacttcatcaatgggatggaagtctgaatcaatatatgaaaatcaataaatgctgtccatc    39060
acataaacagaaccaatgacaaaaccacacatgattatctcaatgcagaaaaggcctttgaaaaaattca    39130
atactccttcaagctaaaaatcctcaataaactaggtattaatggaacgtatctctaataagagctattt    39200
atgacaaagccatagtcaatatcatactcagtgggcaaaagctggaagcattcccttttgaaaactggcac   39270
aagacaaggatgccctctgtcaccactcctattcaacatagtattggaagttctggccagggcaatcagg    39340
caagagaaagaaatagagtatattgaagtaggaagagaggaagtcaaattgtctctgtttgcagatgaca    39410
tgaatgtatatttagtaagctccattgtctcagccccaaaattcccttaagctgataagcaactttagca    39480
aagtctcaggattcaaaatcaagctagaaaaatcacatgcattcctataccccagtaatagacaaacaga    39550
gagccatatcatgagtgaacttccattcacaattgctacaaagagaataaaatgcctaggaatacaactt    39620
aaaagggatgtgaaggacctctccaaggagagctacaaaccactgttcaaggaaataagagaggacacaa    39690
acaaatggaagaacattccatactcatggatttgaagaatcaatattgtgaaaatggcaataatgcccca    39760
agtaatttatagaatcaatgctatcccatcaagctaccatgactttcttcacagaattagaaaaaacta    39830
ccttaaatttcatatggaaccaaaaagagcttgtgtagccaagaccatcctaagcaaaaataacaaagt    39900
tggaggcatcaagctacctgacttctacaaggcccagtaaccaaagcatggtactggtac            39970
caaaactgtgtgtgtgtgtgtgtgtgtgtgtgtgtgtaaaaaatatataaattttcaatatgtaaa       40040
tatataaatacataaatatattatattatattaatgtgtaaatatatattcatatataaaaatatataaa   40110
tatataaatttgtagatatataaattctgacatttaggtttccttcttcttaggaattccaccaaaatta   40180
cacgagtaacactatactaaattttttacctactatcattaaaaaaataatgacttactcaaagctctgaca 40250
ctcattagagcaggttgatatggtagaaaattctagccctatgcaactggagtgatcttgatgctaagac  40320
aatatgacccaaaaccttgtccttttcctttttggctatatgaatattttctaacttttgtgaacaaaatat 40390
gtctcattttcctcatgatggtgtttcaaaatgaattgatgggtgttttcagttattagtggataggag   40460
ctctcttagctcagcccttcaaaaacttgtgtttgatgttgtaatttgtaaattatctcaatgtatgcc   40530
tatatgcttacacacataatcccctacctaaaagatcaaccttagcttttaagaatttcttcctttttattt 40600
ttcctctattttttttttttttttttgagacaggggtcttgttctgttgctcaggttggggtg          40670
taggagtacaatcatagctcactgcagcttttgagctcctgggctcaggcgatcttcccacctcacactt  40740
cagcctcccctgagagcacaggcatgtaccaccacacccagttgatttaaaatctatttttttgtacaga  40810
tgcagttcctatgttattcaggctggtctcgaacttctgccctctagtagtcctcctgcttcaacctcct  40880
cagagtacaggcatgaaccatcattcctggcccccttactattttctatattttacttttagtataagtctg 40950
tgaaagaagtatatttctcatagtttgttgaactgcgcagatgatgatgttgaaggatctgcacgatggt  41020
tatgatggttgctgtcattgcactacagtgcttttaaaaaactgaaaatattcatttctcactagaata    41090
gtcatacaggcatttatttgttgctttagaatttggaaacttcttttttatattcatagttgtatttcatt 41160
ctgccagcagattaggcagattcatcctctcccactttccagtggtagaaacaggtgtcctgaggcagtg  41230
aagtagttgttggaaaatcactgtgtttgctttccagggattttcttgtcctctagctgcgaaagtatc   41300
ataatacatggcacattcccacaggaagttttagggtgtgaaaagtcaatgtattaatatacacatatgggat 41370
ccacttccactcaaagcaaaacacattgagtcaagtatcagagctcagtgggtgtacatgatggcattta  41440
atttttcctaaattacttcatataattaatatacactaagcctttgttatgatgctacacatcattttgg  41510
agtcacaagcttttcaaccttcatctaactaaaagatggatatcttcattttatattaggtggtctggaag 41580
ccatagtagtgttaaagagcacataggaatgttttagtccattcggattgctgtaaggaaatacaatag   41650
actgtgtggcttataaataacagacattttattgctgagttctggaggctgggaattcaagatcaaggtgt 41720
ggcagattcagtgtctggtgaggacacacatctttgtttgttgatagtgccttttccttgtatcctcatg  41790
tggtggaagggataagggagttctctgagttccctttttgtaagggcaccagtccccattcataaggctcca 41860
acctcatgacttcatcacctcccaagggcctcacctcctgatactatcatcttggggtcatgatttcaa   41930
cataggaatttggagtgacacaaccattcagatcatagcagagagagtggacttgccgaactcc        42000
ataaagccatatgaatattttcagttccagtcctatttccattttcaaatgttgagttatgaacttgatt 42070
gatgcctcctggtatttttcaaaatgttctagagctctcatgatcaatattaaacctttcccattcaaag  42140
gacatgattattttatgtgagtaatgtgttgctatttgacaaaggagtacaactataaataaatcttgac  42210
tatcttgatgtaggaaataaatacacctgtcaagatatactataatgcttttgtagtcaaaacaatgatg  42280
gggctagcattgtgactcatgcttgtaatcccagcactttgggaggccgagggaggtggatgacttgagg  42350
tcaggagttcgagactagcctgtcctacatggttaaaccgcatctctactaaaaatacaaaaatcagcca  42420
ggcatgatggtgcatgcctgtaatcccctgatactctggaggctgaggaaagagaatcacttcactccagg  42490
atgcaggggttacagtgagccaagacggtgtcactgcactctagctaggcaccagagtgagactcgatct  42560
caaaacaaacaaagaaaaaatggtggatagaataggatatttaaatgaaaactgtaaggggagttg     42630
tatgctctcaaatgtcattatgcacagtctaatatgtccctttcactctgccactctacctgctaattg   42700
cttccttaattcagacttacctattaggttattagttataatataggttgacaattatgcagcttttctt  42770
ctttaccaagacctgttccaagtgctttttatattaactcattggtgtcaaccactctaccccatagtaa  42840
ccattagtattagtttcctatctgtgctgtggtaacaagttactacagacctagtggcttcatacagttc  42910
taccactcagaagtccaaaatgagacttaggaggctaaaatcaaggtatcatcaggacttcattatttttt 42980
ggaagctctgcgagaggatacatctccctacctttcaagattctagaaacttcctacttcgttggctc   43050
ataggctcctttctccaccttcaatgccagtagactgagtccttgttctgtcatcttttttgtttgccct  43120
cttttcccttttctatgggcacagtccgataacctggaatgatctcccaatttcaaggtctgctgactgg  43190
gaatcttaattccacctgcctctttcattcaaatccccttttccatgtaagaccacacaaccgcgcatatt  43260
aacacatgggcatctcaggggaccattattatgcagaccacacagttgttatcttcattttatagccaa   43330
gaaagacaaacagagttaaatcacttactacgattgttggtctgctaaatggtagagctagttaaaatta  43400
ggagcatacgcagggaagctaggcagtgttgtgatcaaggcccttggcccccctaaagtttcaatgaaaaa 43470
tcatggagataatcagtgactattactgtccactcaaccgggttgcacagagggagagagagaccaggag  43540
cctggctggctgatgataatgtcttaccctattgctagcagtgttggttcctgggttctctgcactgtgg  43610
ctttcaaaagaacagagcagctttggtgaccccacttgttgtgccataactgtagaggccaaggctttt   43680
atccccctaaagttttactgaaaaattactgactaggcagacaatttacaggtgaaatgacatacaaaca  43750
tgcttaatgcagatacaaaggagccttcagaatgaagacgcaacctccctgtgagatcctgaagcttata  43820
taccaacctgagtttacagaaagagttgggggcttggatcccagtaatacagatgatgggaggggggagaag 43890
aggaattctgtcgaggagattactagaacggagattaacttgtaaataactcttttttgaaaattaaataa 43960
tccttgaggacaaccttggaaaactgtctgttgaggtgtggtgtcatcttggttttttttctgcagtcgat 44030
aaggatataacaggaaggggttaaaaacaattattatccttgtgggagtctgtgtcttaggcaaataaag  44100
```

```
aaacttcagctactttgggagaggtagtgggagaggggaggttggacttcttcaactcagcctgtcaaa      44170
atgccatattttggggtattgttttctgagcctcagcaggactcatacagtattgtgggatttggggctg      44240
agccatggtgggacagattttcccctgagatccttatgcatccaaatcagtaggtgcctgttcacgttca      44310
acatgaaaaactgacacaaagcaatgagtaggaaattgggggtaaatgtaatgaaacaaacgtgtgtt       44380
aaacaacatttctccataatattaaactaatgtgaagaatttagagtcaggaattttttctggaaagtgta   44450
ggctccaacttcctcagagtatgatttgtaggatgctcttccccattcactactccacccaacatttctg    44520
acagttatcagaagaaagagacctggtataattaatcaaactcaagacatttaggtcattgtttgcttga    44590
gattcatcaggaggtcttctaaccatgctgcaaacacttaactcatcagggcttcacagatgaatttac     44660
tgattccacaaacttgtaaattgtatttccagagccaatgtgaactctctcagttatggttttgtcttg     44730
aagactgtgactttcatttaaaatgttgtttcaatgatgcattttctgaactcaatgaaattatgaaggg    44800
acagattttaaagtccataacgattttgttttattaaagctgccaaatattttaatatggtgtgaagag     44870
gcacaagaaaatgtaaaccctagttaccactgagacgtcccattgtttagtcatttcagcaccactgcat    44940
agacttccgtaatatgagaaagagacttaatatcctagtcatgaggagcacagggtttagggaaaaatac    45010
atacacagatatatctatatgttgatatacacacacatatacatgcacacacactcacacatacacaa      45080
tcagtgacttcttatgatggttcaactaatgattttcaaccttatgatggtgtgaaggcaatacacattg    45150
tagatgtccacaaaatatttaaaaagctttattctgagccaaataccagtgacctaggcctgtgacacag    45220
ccccaagagatccggagaacatgtgcctaaggggggttgagcatgatttttatacattttgtagggagaga   45290
agttacaggcagatattcatcaattcaaggtatacatttgtttcttccaggaaggtggcacaacttgaag    45360
cagaggattcccggttatagacagattcagaggttttcaaattggctattggttgaaggagttaagttac    45430
ctaaagacctggaatcaatagaaaggagtgtctgggttaagaaaaggtgttgtggagaccaaggtcttat    45500
gcagataaagtctcatagttggccatcctagaagcaatagatgacaaaagtttcccattcagacccttg     45570
aaagatgctagatgctcatctaatcacatcaagatgagcaaaagaccagtcaaggggaagtaaacctgaaa   45640
aacttgttcacaccactttatccctccttggattagatagtgtttgcctcatggttagaagatctcctga    45710
tgaatcttgagcaaacaatgccctaaatgtcttgagtttgattaattatcccaggtctctttcttctgac    45780
aattcaggtaaagagtagaatgcagctcttccttataaaaggcagctttgtgaggccatttcaaaatata    45850
tgaaagaagtatattttggggtaaaatgctttgatttcttttagggcctggtatctatcatgtgatgtta    45920
caccagagaggttgaaatttggtatcttttttgttatcaagtgtctgtttggttggtcttatgatttctgt   45990
tttaatgttaattctggtcagttgtgcccgagttccaaagagagaagtgtatagtgaggcatgtccaatc    46060
cccatatcccctcatcgccagaagaagttttttcaggattagtttggaatgcccttggcagagagggttta   46130
tattcagttaactggggacttagaattttaattttggtttacagaattcactagagactctacatccagt    46200
acccatataatcattctaatttgcacttttggtacaggattcaataaattacatgagatgctcaacactt    46270
tattataaaaatagactttctgttagatgcttttacccaactgtaggctaaagtaagtgtactgcacatat   46340
ttgaaatagactaggctatgttgcatgatatatttggtctatgtgataaattttttgtcttatgatatttt   46410
gaacatatcatggtttttcagatgtaatcgccattgcagttccaggaacatctgtatgtattttatgtg     46480
tgtgtgtgtatgtctgtgtgttgtgtgtgtatgtgtgttcttcaactccttggacagatctcaac         46550
cttttcagaggcttcgttttcttctttgtaaaatgggaacagtggtatttctcttctatggaatgtcattgt  46620
gagtaatttagaaaagcgtagcattcaaccgaaaccttcatagcatttattgcctggaaaatgatgttg     46690
atttctaggggagataagtactttcttatttatcacatttcataaaaggaaggaacctacttttcttgaa    46760
ttctaaaacacatatgtgcattgggaatgggaatgagaatacacttagcaaaatgatccctctgaagaca    46830
atggcaatgtgtttgccaaggggattaattagacgtattttgcaatactgtttatagaatggaaaacaag    46900
aaattgagaggaggtagttggaagtgtgcacttctctgcagatcagccaactggcctcagtactttaggt    46970
.aagggattttaatttgtcctttggtttacaggacaacgcagacttactgctgtttatattcatcaaacac  47040
acatacctgagtagcagatctctactctcccttttaaataaggtaattctatggaacatttttgaaagcct   47110
agaaaaatgtaatacagaggtgatgtgaaagaaaattacatctattgtcctgttatccttgactttctc     47180
tggatataaatgttttccacattttttgcaacctttctctgcctaagctttcattttggggaaaacataac   47250
agtgtatgatttctgtgtgtgttaattctaaaattgcaaagttaatcccacaccattgtggagataaact    47320
tttgagtttctgtttgaaaatttggggatatggaaattgtcaaatactgctgatatatatgtttaagaga    47390
cccagggcatgaaaacatctggatttttaaatatattgtctggtaatcatataatacatcgtcctacat     47460
tgagaggtaactgtttattaatcatagtttctcttctatatttattattacttaggttctgggtta        47530
catgtgcagaacgtgcactttgtaataagtatacatgtgccctggtggtttgctgcacccatcagtccat    47600
tacctacattaagtatttctcctaatgttatccctccttaggccctaccattgacaggccccagtatg      47670
tgatgttcccctccctgtctccatgtattctcattgttcagctccactaatgagtaagaacatgtgttg     47740
tttggttttctgttcttgtgatagtttgctgagaatgatggttttccagcttcatccatgtccttgcaaag   47810
gacataaactcatccttttttatgtattccatggtgtatgtgccatatttttcttaattcagtctatca     47880
ttgatggacatttgggttgtttccaagtatttgctattgtgaatagtgcctcaataaacatacgtatgca    47950
tgtgtctttattgtagaatgatttataatctttggatatatgcccagtaatgggatttctgggtcaaatg    48020
gtatttccagttctagatacttgaggaatcaccacaccctcttccgcaatggttgaactaatttatactt    48090
ccaccaacagtgtaaaagtgttcttatttttccgtaatgtctccggcatctattgtttcctgacttttta    48160
atgactgccattctaactggcgtgagatggtatcttatttttgttttgatttgcatttctctaatgacca    48230
gtgatgatgactattatttcatatgtctgttggctacataaatgtcatcctttgataactctctgttcat    48300
atactttgaccatttttttgatggggtttctttttattcttatcaatttgtttaagtgctttgtagattct   48370
ggatattagcccttgtcagatggatagatttcaaaaattctctcccattctctaggttggctgttcact     48440
ttgatagatttctttgctgtgcagaagctcttagtttattttcatccccatttgtcaatttgactttt      48510
tgttgccattgcttgtggggttttggacatgaagtcttttgcccatgcctatgtcctgaatggtattgccc   48580
aggttttctttcaggaatttttatggtcctaggtcttacatttaaatctttgatccattttgatttgattt   48650
ttgtaaaagatgtaagaaagggggtccagtttcagttttctgcatagctggccagttttcccaacaccatt   48720
tattaaatagggagtcttttccccaccacttgtgtgtgacagctttgtcaaagatcagatggttgtacct    48790
gaggcctccactttttccattggctctatatatctgttttggtacccataccatgctgatttgtttactg    48860
tagcctgttagtatagtttgaagtcagttagcatgatgcctctatcttttgttcttcttgctcaggattgt   48930
ctggacaatctggcccctttttttggttccatatgaagtttaaagtaccttttttccaagtctgtgaaaaag  49000
acagtggtagcttgatggggatagcatttaagaaattactttgggcagtttgaccattttcaatatattg    49070
attcttcctatcctttagcatggaatgcttttccatttgtttctgtcctctcttatttccttgaacagtg    49140
gtttatagttatcctttgaagaggtccttcacatcccttggaagttgtattcctaggtattttattctctt   49210
```

FIGURE 11A-10

```
tttcacaattgtgaatgggagttcactcatgatttggctctctgttttctgttatcggtgtataggaat      49280
agttgtgattttttgcacaggattttgtatcctgagactttgctgaagttgcttattagcttagggaggtt    49350
ttgagctgagacgatgtggttttctaaataaacaatcatgtctgtgcaaacagagacaatctgactccct    49420
cttttcaaagttgaatactctttatttctttctcttgcctgattgccctggccagaatttccaatactat    49490
gttgaacagaagtggtgagagagggcatccttctcttgtgacggttttcaaagggaatgcttccagcttt    49560
tgcccttcagtatgatattggctgcaggttttcataagtagctttaattatttagagatatgtttcatc    49630
tttacttagtttattgagagttttttagcatgaagtatgttgacttttttgaagcctttttctgcatctat   49700
tgagataatctcatggttttttgtcattggctctgtttatgtgatggattatgttattgatttccatatgt   49770
tgaattagccttgcatcccagggatgaaaccatctcaatcgtattggataagcttttttgatgtgctgctg   49840
gattctgtttaccagtatttattgaggagtttcacattgatgttcatcagggatattggtctgaaagtt    49910
tatttgtctgaagtgtctgtgccaggttttggtatcaagatgatgctggcctcataaaatgagttaggga    49980
ggattccttcttttttctgctgtttggaatagtttccaaaggaatggcaccagcttctctttgtacctctg   50050
gtagaactgggctgtgaatatgcctggtcctttttatttgttggtaggctatttattactgcctcagtt    50120
tcagaacttgttattggtctattcagggattcaacttcttcctggcttagactttggagggtatatgtgt   50190
ccaggaatttattcattcttctatagaattactagttttatttgctagagagtgcttataatattctctgat  50260
ggtagtttgtatttctgtgtgggattactggtgatatcccctatgtcatattttattgagtctgtttgattc  50330
ttctctcttttcttctttattaatctggctattggtctatctattttgttgatcttttcaaaaaaccag     50400
ctactggattcattaatcttttgaaggattttcatgtctcgatctccttcagttctgctctcatagcag     50470
ttatttcatgtcttctgctagctttggaatttgtttgctcttgcttctctagttgtttttaattttgatga   50540
tagggtgtcagtttttatatctttctgcttctctttctggacattaagtgctataaatttccctgtgaac   50610
actgctttaaatgtacccaaacattcggtacgttatgtcttgtttctcattggttttccaagaacatct   50680
ttatttctgccttcatttctcgagagggggggccgaagccagggagctaagtggtctggatcggtgggtcc   50750
caacctgatagagcccaggaaactaagattcactagcttgaaattcttgctgccagaacagcagcaatct   50820
gagatccacctgggacagtggagcttagttggggagaggagtccaccattgcttgagtaggtggttttat   50890
ggccacagtataaacaaagctgccaggaagttcaaacttggtggaacccactgcaactcagcaagttggc   50960
tgtgcccagacttccagatttctctgctctggacagggcatctctgtaaaaaggcagtagcccccagtcag  51030
gggcttatagccaacttaaatgtccctgtctgaaggctctgaagacagcagccaacctcccagcatggtg   51100
ttcaagctgtgctagggtcagtctgcttcctcaagtgggtatactgactgaaagacacctcccagttggg   51170
gccaagagacacctcatacaggagagctctgcagcgcatcctggcagttccctgctggtcaaagcttcc    51240
agaggaaagaacaagcagcaatctttgctgctttgcaggctctgctgatgacacccaggcaatcagggtc   51310
aggagtggacctccagcaaactctagcatactgacagcagagcagcctgactgttagaaggaaaagaaac   51380
aagcagaaaggattagcatatccactcaaagacccatccaaaggtcaccaacgtcaaagaccaatggta   51450
gataaatccacaaagatggggaaaaaccagcacaaaaaggctgaaaattccaaaaaccaggatgcctctc   51520
ctcctccagaggatcacaactcctcaccagcaagggaacaaactggatggataatgagtttgatgaact    51590
gacagaagtagggttcagaaggcgggtaataacaaacaactctaagctaaaggagcatattctagtccaa   51660
tgccaggaagctaagaaccttgaaaaaaggtgagtctaattgttaactagaataaccagcttgagaagaa   51730
cataaacgacatgatggagctgaaaaacacagcacgagaatttcgtgaagcatacacaaatatcaattgc   51800
tgaattgatcaagcagaagaaagaatatcagtagtttgaagatcatcttaatgaaataaagagagaagaca  51870
agattagagaaaaaaggataaaaaggaatgaccaaagccttccagaaaatatgggactttgtgaaaagacc  51940
aaatctatgcttgattggtgtacctgataatgacagggagaatagaaccaagctggaaaacacccttcaa   52010
atattatccagtagaacttccccaatctagcaagatagtccaagattcctattcaggaaatacagagaac   52080
accacaaagatactccttgagaagagcaaccccaagacacattgtcatcagattcaccaaggttgaaatg   52150
aaggaaaaaatgttaagggcagccagagagaaaggtcgggttacttataaagggaagcccatcagactaa   52220
cagcagatctctctgcagaaaccctacaagccagaagagagtgggggtaaatattcaacattcttaaa     52290
ggaaagaattttcaacccagaatttcatatccagccaaattaatctcttaagcaaaggagaaataaaat    52360
cctttacagacaagcataggctgagggattttgtgactaccagacctgccttacaagagtgcctgaagga   52430
aggacaaataaggaaagcagcaaccagtaccagccactgcaaaaacatgccaaattctaaagaccattga   52500
cactaaaagaaactgcatcaattaatgggcataataaccagctaaaacataatgatgatcaaattc       52570
acacataacaatattaaccttaaatgtaaatgggctaaatgtcctaattaaaagacacagactggcaaat   52640
tggataaagagtcaggacccatcagtgtgctatattcaggaaacccatctcacgtgcaaagcacacata   52710
ggctcaaaataaagggatggaggaagatctaccaagcaaatggaaaacaaaaaaggcagggggttgctat   52780
cctagtctctgataaaaacagactttaaaccaacaaagatcaaaagagacaaaagaggcattacataatg   52850
gtaaagggatcctatgcagcaagaagcactgactatcctacatagatatgcatccaatcaggagcatcca   52920
gattcataaagtaagttcttagagaccgacaaagagacttgcactcccacacaataatagtgggagactt   52990
taacagcccagtgtcaatattagacagatcaatgagacagaaaattaacaaggatattcaggacttaact   53060
cagctctggaccaagtggatctaatagacatctacagagctctccaccccaaatcaacagaatatacatt   53130
cttctcagcaccacatcacactattctataatggaccactacaagtaaaactacttcctagcaaa        53200
tgctctccatcccaaatcaacagaatatacattcttctcagcaccacatcacacttattctataatggac   53270
tacagaactgcaagtaaaacactcctcagcaaatgcagaagaacagaaattagagcaaacagtctaccag   53340
accactgtgcaatcaaattagaactcaggattaagaaactcactcaaaaccacacaaatacctggaaact   53410
gaacaacccgctcctgaatgtcttctataattttgaaagccagcttcatatttcctgccctagggggatg   53480
aagtaaagtaagcagtagatctagttagatatatgttatttttgttagcaaggggttaatttgaatttt    53550
gccattttataacaactgattgtggctgggaacatgctaatgtttatggtgactgtattcactctttctt   53620
tgctttgaattttttttttttttttttttttttgggagatggagtttgctcttgctgcccaggctgga     53690
gtgcaatggcacaatcttggcttactgcaaccactgcctcgggttcaagcaattcttctgcctcagcct    53760
ccccagtagctgggattataggcatgtaccaccacgcctggcaaattttttgtatttttagtagagagag   53830
gtttctccatgttgaggctggtctcgaactcctcaggtgatccaccaccttggcctcccaaagt         53900
gctcggattacaagtgtgagccaccacgcccagattttttttttttttttttattgtaacagggtctcat   53970
tctgtcacccagactgaagtgcagttgtgccatctcagctcactgcagctttgaccttctgtgctcaagc   54040
aatcctcccacctcagcctcctgagtagctggaactacaggtatacaagtgtgtgccaccatgcttggct   54110
aattttttattttttgtagagatgggttttgccatgttactcagcctagtctggaaatcctgggctt     54180
gagcaatctgcccacctagccttcccaagtgctggaaatacaagtgtgagccactgtgctcagccttga   54250
tttgaatttgagggatagtatagttctgtgttactacacctagtagaatattagcatattcagtgacttt  54320
```

FIGURE 11A-11

```
aattagaccttagtgtaatccccagtaacaatctgttgccttggatgttctgttttctttcttttttttt    54390
ttaaattatactttaagttttagggtacatgtgcactacgtgcaggtttgttacatacgtatacatgtgc    54460
catgctggtgtgctacaccgttaactcgtcacttaacattagctatatctcctaatgctatccctcccc    54530
actccctccaccccacaacaggtcccagtgagtgatgttcccttcatgtgtccatgtgttctcattgtt    54600
caattcccacctatgagtgagaggatgttctgttttctaaaggtatatacgagattcttgtattcttttc    54670
atattagagaccctggccagagtaggagctgtagaggccacagtgagcccttcaggagaatgagataca    54740
gcagagtcactgcttgtgttcttgagatgattggatgacaaagagggaaatgataatgttaactgaggaa    54810
agtctagaactgcaggttaccatatgtatccccatatttttaaccctcacctgttgttccattgtattttc    54880
tatgtaagttttttacttgcagtcctatttctttcttatttaaaaatcatgttaatcattggtattagtag    54950
catcctttgccagataaaaaggaaaaactaaagtgaatgctttatgacgatatgtgggaggaaagaatgta    55020
atagcacttgaggaatattggaactgattatatattacatggcagtgggtagtgtttaataaaatgatta    55090
tatttcatagaaagcattacatctcttctttgagtgagaaacatagagataatttcatgctaccctcaccct    55160
ttctttttaaacatatatatattttttttaaattttaagttagaatttgagtaattgtattaccatatatat    55230
atttttttaaattttaagttagaatttgagtaattgtattacatgtggtgctgtttttctcagaggaaaaat    55300
cagcaaattatttcaaagatatggaggatatggtgtttctctatatccaggtgggactgaacaatgtatt    55370
agccaaggaaaaccttcccttcacccactggaggctcactgaaaatcatgtcacaaaaagcagattaat    55440
agtagaaaagcgatacatatttattaagtcatagatctgtgtaacacaagagccttcagaacgaagacgc    55510
aaagataagatggagaccattttttttttcttaattttcaacttttattttaaattcagaggatacagcctt    55580
gctacatgagaatatttcatggtgctgatgtataaggtactgttgatcccaatcaatagtggtaagcata    55650
gtggccactagctagcttttcaacccataccctgctttctccccagtctagtagtccctgtgcctattgt    55720
tcccatctttctttccagatttactcaagctcccacttgtaactgagaacatacagtatttaatttcctg    55790
tatcctgtgttaattcatttagtatggtggcctcagcagtcatgtttctgcaaaggacctgatttt    55860
gttcgttttcatggttgcatagtattccacagtgcatgtataccacatttttctttattccaccactgata    55930
agcatccaggttgactcatgcctgttttttgctattgtgaatattactgcagtgaacatacaactgcatgt    56000
gtcttttttgtagaaaaatttattttcctctaggtatacacccagtaatgggattgctgggccaaatggt    56070
agttttgttctaagtcctttgagaaatctccaaactactctccatagtagcgtaaatattttacgttctc    56140
accaggagtatataagcattccttttctctgcaacctcactagcttttgttggtgttttttttgttttttg    56210
tttttgactttttaatagtagccattctgactggtgtgagatggtatctcattgtggttttgatttacat    56280
ttccctaatgaacagtaatgtggagcattttcatatgtttattgatacttatatgttgagaagtatatg    56350
tccatgttcttggcacacctttaatgtggttattcggaaactcaattttatgccaagattcaggaaac    56420
tgcacagccagtagaaataagattggacaaaaaggccctgatctaaagctaatgggcgtgagtggggaaa    56490
ccagccaggcctgtctgcctagattcttcttggcctttctgaacagcacttcttcctctctggatgtggg    56560
ataggaccctctctggaataggggtcttaggacctacaattcacactgttaggacagaagatttctttat    56630
ggccagtgtttaagaaagtcaggggaaagtaaggtcatctttatggctgctttgatagagaagcggt    56700
ctggtttgtatgacctgcctttaggaggagaggttctagttctcttggccagcctctaggagaatggaa    56770
ttgagagacagcaggtcaggaaaggtcagagataaaccttctgcctcctgaggctgttgaagtcttcatt    56840
ttgtggtatcattctctgaacccaacaacacacattgttttaacttcatcaaaacacttagatcagtt    56910
gggtccaaacatggggtttatacactgtgtggcaaaagtatggtccttccctctactccaaagggaacaaa    56980
tgaaattattatttatttatttatttatttatttttattatactttaagtttttagggtacatgtgcaca    57050
acgtgcaggtttggtacatatgcatacatgtgctatgttagtgtactgcacccatttactcttcatttaa    57120
cattaggtatatctcctagtgctattcctgatccctcccccaccccacaacagccccagtgtgtgatg    57190
ttcccccttcctgtgtccatgtgttcagttccncacctgtgagtgagaacatgtggtgtttgg    57260
ttttttgtccttgagatagtttgctgagaatctaacggtttccagcttcatccatgtctctacaaaggac    57330
atgaactcatcattttttatggctgcatagtattcaggggtgtatatgcgccacatttcttaatccagt    57400
ctatcattgttggacatttgggttggttccaagtctttgctattgtgaatagtgcagcaataaacacacg    57470
tgtcatgtgtctttatagcagcatgttttataatcctctgtttataccagtagtgggatggctgtggg    57540
tcaaatgttatttctagttctagatccctgaggaatcaccacactgacttccacaatggttgaactagtt    57610
tatagtaccaccaacagtgcaaaagtgttcctatttctgcacatcctctccagcatctgttgtttctgac    57680
tttttaatattcgccattctaattgttgtgagatggtatctcattgtggttttgatttgcatttctctga    57750
tggccagtgatgatgagcatttttcacgtttctgttggtggcataaatatcttctttgagaagtgtct    57820
gttcatattctttgcctacttctgatggggttgttttgtttctttcttgtaaattttgttgagttcatta    57890
tagtatctggatattagccctttgttagatgagtagattgcaaaaattttctcccattttgtaggttgcc    57960
tgttcactctgatggtaatttcttggctgtgcagaagttcttagtttaattagatcccatttgtcaat    58030
tttggctattgttcccattgttttcagtgttttagacatgaagtccttgctcttgcctatgtactgaatg    58100
gtatggcctaggatttcttctaggggtttttatggttttaggtctaacatttaggtcttaatccatcttg    58170
aattaattttgtataaggtataaggaagggatctaatttcagctttctacatatggctagccagtttc    58240
ccagcaccatttattaaataggggaatcctttccccttttcttgtgtttgtcaggtttgtcaaagatcaga    58310
tagttgtatatatgcgacattattctgacggctctgttctgttccattggtttatatctctgttttggt    58380
accagtaccatgctgttttggttactgtagccttgtagtatagtttgaagtcaggtagcatgatgtctgc    58450
agctttgttcttttggcttaggattgactaggcaatgcagggtctttttggttccacatgaactttaaa    58520
gtagttttttccaactctgtgaagaaagtcattgatagctcattgaatctataaatta    58590
ccctggacagtatggccatttcacgatattgattcttcctgcccatgagcatggaatgttcttccattt    58660
gtttatatcctcttttatttcattgagcagtggtttgtagttctccttgaagaggtcattcacatccctt    58730
gtaagttggattcctaggtatttttattctctttgaagctattgtgaatgggagttcattcatgatttggc    58800
tctctgtttgtcttattggtataagaatgcttttgattttttgtatcctgagacat    58870
tgctgaagttgcctatgagtttaaggagattttgggctgaggatgatggcgttttctagatatacaatca    58940
tgtcatctgcaaacaggaacaattaacttcctcttttcctaatcgaatacccttttatttcttctcctg    59010
cctgattgccctggccagaacttccaacactatgttgaataggagtggtgagagagggcatctttgtctt    59080
gtgccagttttcaaagggaatgcttccagtttttgcccattcagtatgatattggctgtgggtttgtcat    59150
agatcctcttttgatatgtcccaccaataccgaatttattgagagtttttagcatgaaagt    59220
tgttgagttttgtcaaaggcctttttctgcatctcattgagataatcatatgattttttgtcattggttctct    59290
ttatatgctgtattaggttttttgatttgtgcatgtgaatcagccttgcatcccagggatgaagcccac    59360
ttgatcatggtggataaattttgatgtgctgctagattcagtttgccagtatttttattgaggattttg    59430
```

FIGURE 11A-12

```
cctaggtgttcatcaaggatgttggtctaaaattctcttttttgttgtgactctgccaggctttgttgt      59500
caggatgatgctggcctcataaaatgagttagggaggatttcctcttttctattgattgcattagtttc      59570
agaagcaatggtaacaggtcctccttgtacctgtggtagaattcggctgtgaatccatctggtcctggac    59640
tttttttgcttggtaagctattaataattgccgcaattgcagagcctgttattggtctattcagagattc    59710
aacttctttctggttagtcttgggaggttgtatgtgtctaggaatttatccatttcttctagattttct     59780
aatttatttgcgtagagttgtttatggtattctctgatggtagtttgtatttctgtgggatcggtggtga    59850
tatcccctttatcatttttcattgcaactatttgattcttctctcttttcttcttttattagtcttgctaa   59920
cggtctgtcagtttttgttgatcttttcaaaaaacgagctcctggattcattgattttttgaagggttttt   59990
tgtgtctctatttccttcagttctgctctgatcttagttatttcttgccttctgccagcttttgaatgtg    60060
tttgctcttgcttttgtagttctctttaattgtgatgttagggtgtcaattttagattttcctgctttct    60130
cttgtgggcatttagtgctataaatttccctctacacactgctttgaatgtgtcccagagattctggtag    60200
gtagtgtctttgttctcattggtttcaaagaacatctttatttctgccttcatttccttatgtacccagt    60270
agccattcaggggcaggttgttcagtttccatggagttgagcagctttgagtgagtttcttaatcctgag    60340
ttatattttgattgcactgtggtctgagagacagtttgttatgatttctattcttctgtggtgctgaaaataatgtatatt  60410
agtgctttacttccaactatgtggtcaatttggaataggtgtggtgtggtgctgaaaataatgtatatt    60480
ctgttgatttgggttggagagttctgtagatatctattaggtccacttggtacagaggtgtgttcagttc    60550
ctggatatcctgtttagtttctgtgtggctgatctgtgtaatgttgacagtggggtgttaaactctctca    60620
ttattattgtgtgggagtgtaagtctctgtaggtctctaaggacttgctttatgaatctgggtgccctg     60690
tattgggtgcatatgtatttaggatagttagctcttcttgttgaattgaccccttaccattatgtaatg    60760
gccttcttcgtctctttgattgtgttggtttaaagtctgttttatcagagactaggattgcaaccctg     60830
gcttttttgttttccatttgcttggtagatcttcctccttcccctttgttttgagcctatctgtgtctgt    60900
gcacatgagctgggtttcctgaatacagcacactgataggtcttgactgtttatctaatttgccagtctg    60970
tgtcttttaattggagcatttggcccatttacatttaagattagccttgttatgtatgaatttgatcctg    61040
tcattatgttagctggttattttgctcattagttgatgcagtttcttcgtatccttgacggtcttacaa    61110
tttggcatgttttttgcagtggctggtaccagttgttccttccatgtttagtgcttccttcaaaagctct    61180
tgtagggcaggcctggtggtgacaaaatctctcagcatttgcttgtctataaaggttttatttccccttc    61250
acttgtgaagcttagtttggctggatatgaaattctgagttgaaaattcttttctttaaggatgttgaat    61320
attggcccccactctcttctggcttgtagggtttctgtcaagagatcagctgttagtctgatgggcttcc   61390
ctttgtgggtaacccaacctttctctctggctgcccttaacattttctttcatttcaaccttggtgaat    61460
ctgaaaattatgtgtcttggagttgctcttcttgggagtatctttgtggcgttctctgtatttcctgaa    61530
tttgaatattggcctgccttgctagattgggaacttctcctggataatatcctgcagagtgttttccca    61600
cttggttccattctccccgtcactttcaagtacatcaatcagatgtagatttggtcttttcacatagttc   61670
catatttcttggaggcttttctcttttcttttttattctttttttctctaaacttctcttctgacttcattg   61740
cattcatttgatcttccatcactgataccccttcttccagttgatcacatcggctactgaggcttatgca    61810
tttgtcatgtagttcttgtactgtggttttcagctccatcagctcctttaaggacttctctgcattggtt    61880
attcttgtatccattcgtctatttttttttcaaggttttaacttcttttgccatgggttcaaactttctc    61950
ctttagctcagagtagtttgattgtctgtagcctcttctctcaatttgtcaaagtcattctccatccag    62020
ctttgttccattgctggtgatgtgctgcattccttcagaggaggagaggcactctgattttagagtttc    62090
ctgttttttctgttcggtttttttccccatctttggtttttatctaccttcggtctttgatgatggtgac   62160
atacagatgggtttggtgtggatgtcctttctgtttgttagttttccttctaacaatcaggaccctca    62230
gtagcaggcctgttggaatttgctggaggtccactccagaccctgtttgcctgagtatcagcagtggagg    62300
ctgcacaacagtggatattggtgaacagcaaatgttgctgcctgattgttcccctggaagttttgtctca   62370
gaagagtacccagctatgtgaggtgtcagtctgccccctactaggggttgcctcccagataggctactcgg   62440
gggtcagggacctacttaagaaggcagtctatccattctcagatctccagctgggtgctgggagaaccac   62510
tactctcttccaagctgtcagacagggatatttaagtctgcagagtttttgtgctgccttttgtttggcta   62580
tgcccttcccccaggggtggagtctgcagagacaggcaggcctcttgaagtgtggtgggcccacccag     62650
ttcgagctttttggctgctttgtttacctactcaagcctgagaaagcgtgggtaccctcccccagcctc    62720
actgccaccttgtagtttgatctcagactgctgtgctagcaatgagtgaggactttgtggtgtaggacc    62790
ctccgagccaggcgcaggatataatcttctggtgtgctgtttgctaagaccattggaaatgcacagtatt    62860
agggtgggagtgacctgattttccaggtgcggtctgtcatcccttcttttgactaggaaagggagttccc   62930
tgacccttgcacttccaggtgaggcgatgcctcaccctgctttggctcatgctcggtgtgctgcaccc     63000
acttctgacactccccagtgagatgaaccccgtacctcagttggaaatgcagtaatcacccatgtctg     63070
catcgcttatgctggaagctgtggactgagctgttccactattcggccatcttggctgtccaccccccatgaa  63140
gtttattttggagaaagttaactcagaacagaaggacctaggggatatcagagagttgagatggggcaagg   63210
gcctgggctccctgtctgtcctgacaaagttagaacagaaggacccagagacatcagagagtggagtgag   63280
ggtgagggcctaggctccttgtttgtaagggaattgtctacactgtgcatactaatgatcatcagctttc    63350
ttgtccttccttcaaagttgaaagtcaccgtactccttcaagtccatcctggaggatcccttttcttcata   63420
aactgaactggccaagaaaagtattccataattggtatttaaaggccatttgggcctattacttatgtac    63490
tgtacaatatgttcacctgctgaggagggaaccctggctatccacacagacctgattcttaagtgagaaa    63560
agacagtcttaaatcctagatattcttgagaaggcttcaataagaaactcattttaaaaattgaaaaaat    63630
aatcatctggaggtagcacacacaccaaccaaggaaacaggacaaaattaatctgtaacctgtaggaaa    63700
tacactgaagtagtgactcataaaaaaatgggaattctattaaaatgtaacatattacacaaattaaagt   63770
atcctattggagagagaatgtgaggagatctccaatggatataaaacttcagttagagagagtgatagcaaa 63840
gggaaaggaacaaatatggagactctaggaatctgacattcaaagagtattttcaggaaggatgacagag    63910
aatacaaataagcaaaagtgacttacattcaaatagtgtttaaaaagtaatcccagcgttattgtgtaac    63980
agtgctgaaataaatgtatctgtacatgtgtcttcatagttgaatgatttataatccttttgtatatac    64050
ccagtaatgggattgctggatcaaatggtatgtctcattctaggtccttgaggaatcaccacgttgtgtt    64120
ccacaacagttgaactaatttatactcccaccagcagtgtaaaagcattcccatttctccacatcctctc   64190
tagcatctgttgttttcctgacattttaatgatcgccattctaactggcatgagattgtatctcattgtgg   64260
ttttgatttgcatttatctaatacaccatgaaatatatgcagccatgaaaaggatgagttcgtgtccttt    64330
tgcagggacatagatgaagctggaaaccatcattctcagcaaactaatacaagaacagaaaaccaaacac    64400
cacacatgttcttactcatgagtaggagtttgaacaatgagaacacatggacacagggaggggaacatcacac 64470
accagggcctgtcatgtggtggggagtaggggagagatagtattaggagaaatacctagtgttgatgac    64540
```

FIGURE 11A-13

```
gcgttgatgggtgcagcaagccaccataccatatgtatacatatgtaacaatcctgcacattctgcccat      64610
gtacccagaacttaaaatgataataataattgccatcatcatcatcatcatcatcccagcatt              64680
gagggatctacacttccaggcttaggaaacaacatcagggttcatcacagtgaaagaattgaaactccaa       64750
actccaaaagcacattgtgagatttcagaagagcaaatatgtgggaaagaccataagagcttgaaggctg       64820
tattagtccattcttgtactgacacaaataccccgagattggataatttataaagaaaagaggtttaattg      64890
gctcatggttttttaaactgcacaggaagcatgaatagcgtctgtggtggcctcaggaatgtttcaatcat      64960
ggcagaaagtgaaagcaaagcaggttcatcttatgtggctagagcaagaagaggagagagagacagaacatg     65030
ctacaaaattttatacaaccagatcctgagaattcacttactacagtaccaaggggggatatacagt         65100
atcattctagagaactctgccctccatgatgccatcacctcccgccaggcaccatctccaacactgggga       65170
ttagaattcaatatgagatttgggtgaggatacagatgcaaaccgtctcaagaatttgtaatttcataga       65240
atgcttcatgttttcaccaaatgttaaaaatataaaactttcattattctaagaaaaaataattttacc       65310
acatagaactcttatcttggagcagctctttgtgggcaggcagagtcaaagcatttacgctgatgtatca      65380
tttcaaaaaatttacctttcatgcttcccttcttggaaagatgtgtgatcgtgtgttccttcaaacagtg      65450
gaataaatgatgaatacaaagatggagaatctaagaaacagtggccttcacagaagacagctgaagtaat       65520
taagacatcagattattgcctggagcaggctgggacatctgacatcctagagttaaactttgaggagaat       65590
gaactaaaagaaaaggaagtaagccatttgaccaggtagaaatagtactcgagatgggctttagtccag        65660
aaaaattgaacaatatacacacagacaagcatgaaatgaaaacctgaagcagttattgtctccagataaa       65730
acaggaggtgattcaatgaaggagatttaattgggtagaaggcttagttcaggagtgattagttcagga        65800
gtaattgcacagttacagtaaagttgaagagagaaggctggtacagtggatcatacctgtagtcccagc       65870
actttgggcggccaagacaggcagatctctttagcccaagactgggagaccagccgggcaatatggcaa       65940
aacccccatctctacagaaaaaaaaatgaaaaattagccagtatggtggcacttgcctgtagtcctagtt     66010
atggcagagtctgaggtggaggatgtttgaacctgggaagtcggggttgcagtgagtgtgattgtac          66080
cattgcactgcagcctgggcaacagagcaagaccctgtctctaaaaacaacaacaaacaaacaaacaaac       66150
acggggcaaatagagtggggggttgcccataggtaattaataggtaatatctaaaaacaatatatcaagaa      66220
aaaatagcactgaactatttcttagtaatatcaagaagatatttgaaggagagaagctaagaaatctgaaa     66290
gcatttgccttctagcaagtgtggtcctgggatgtcgtatgctgtgcaagaaagtgctgttgtgcaaata      66360
acacctgtagtagttcgacttttaaaaattcatgcatgcgggaccatcctggctaacacggtgaaaccca      66430
tctctactaaaaatacaaaaaattagctgggcatggtggcaggagtctgtagtccctgctactcaggagg     66500
ctgaggcaggagaatggcgtgaacctgggaggtgggagctccagtcaggtaagcagagatcgcgccactgccctc 66570
cagcctgggtgacagagggagactccatccacaaaaaaaacaaaaaacaaaaaacaaaaaaacaaagaaa      66640
aaaaaccaaaaaaaaaaaaaaaaaaaaaaaaaaaaaaacacctcacgcatgcctttctttgtttccaaagaaa    66710
caagtagttttatactacttacatattatggtagaatgatttataatcttttggctatatactcagtaat      66780
gggattacttggtcaaatggtatttctactattctttgtttccaaagaaaggcatggtatgaaatggtt       66850
tccaacagttggagaaacaaatttttttttccaaaagaaaaatgataaggccaagattgaatggtatgtga     66920
atgtgaatatgatagttaaaagcattatttctcaaatgtacccttcccattggaatcagctggagaatgta    66990
ataagtattaatgcctgtgctatggtcctccagagatactgacttgcttggtctgcaatgcagaccgggc      67060
agtgagattttttttcagttcttcttagggattgtgagatacagcagagtttaggaagcatggatctaggt    67130
ttgctcagattcttactttcatttaaaaatctgtatctgggcacaatgggtcataacctgcaatcccagaa    67200
cattgtactgggtggaggtggcaggatcatttgtatccaagaagctccagacaagcctgggcaacatagtg    67270
aaaccccatctgtatgtgaaaaaaaaaaaaaaaaaaaaaaaaaagaaaaagaaaaaaattagccaagtgt      67340
aatagttcatgcctatgttctcagctattcaggaggctaaggtaggaggatcacttgagccttggaggtc     67410
atggctgcagtcagctgagatcacaccaccacactctagcctgtacaacagagtgagaccctgtctcaaa     67480
caaacaaacaaaaattacgcagtgtactcttcaacaagataaagttggtttcagtaataaaactactaataa   67550
tatgatgattttagattgagcaaacttcacttagtcatttctttttttattatctgatatgttctttataaa   67620
aagttttaattgcttaaaaatgacctaatgcttctcccaagcttcctttttttttttctctctctcttaac    67690
tgaagtcacagaatgttctcctttgtggagtgctaaacaacattaagaaattattagctttaaggacatt      67760
ctaagagtaaggttataaacctaaaaccccctaaaaggtaaaagaaaattgaagaggcagtacaaagactg     67830
tcctctctcaaagggtccctctcatggaaataggctgctcctgggtgcagagaaagaccttgtctc         67900
gaagcccattgtgtatgcccatggcaccattccagcttaattgttccaattcctcctgtttctctgact      67970
gcacatgaggttaaattaaatataattttctcagtttgcatttcccaggcagtcatcctaagtggcttct     68040
tgaaggcggtctgtgcattccgctatctaattctgtgatgtccttttaactcgagggccagtgacatgatt    68110
atcagctctagaagttcattctgtggtcagagatgcttgtgcagtggccattttcttttcattatgatctg    68180
gccttttcccaagcttcagaagtgaagagaattgacttcctactaatgagcattggcacttaggaagtga     68250
atactttatcttttgcagctagtgtgttctacatttcttcagtgtacctcctgcctggtaaatatcgat      68320
tatttgttgaccatctctcagggtatagttcttgtgttattaaatgagaaacctagtggcttacaaagca     68390
ttggcttttgaggagccactttttatcctagatgataactcaaatccatacagtgctgatatttacagctg    68460
ggagatgacattgtcttatcttggtctattgctcaaatttctgatttcagcaggacttactcactggc       68530
tgccttctgtcttggggatgcctttgatctgtcttgccttgggggaccctccctctgacctggattagca    68600
gcctatttccacaagaatggaccctctgagagaggacagtcttcgtactggctcttccgatttttcctttta  68670.
tctgttatgggttttgggtttataaatttactcttagaatgtccttaaagctaataattttttaacgttc    68740
tttagcatattactaaaagctattcatctgcttgagagactgaggaaggagtgttgcttgagcctgaaag      68810
attgaggctgcagtgagctgtcagtctgccactgcactctgggtgacagagaaagaccttgtctc          68880
aaaaaaataaaaaggacaggtacaatagctcatgcatgtaatcccagtactttgaggggctgaggcagga     68950
ggattgcttaggcagagttctagaccagcctgcaacataggagatccatctcttcaaaacataaaaa        69020
attaattagacatgatggcacatgcctgtagtcccagcttcttgaggggttgagaccagcaggaggattt    69090
ctagggcgttaggagttccaggatgcaatgagcaataactattagtaatacatatttgaaaccagttgtt     69160
ggagaattagtatgtgttctcccacaaattcagtatgttttgtaatggtccaactaattcaaatggtat      69230
aaacataatataagcaaattattttatgttgtttgtttaaaaaccttttgactgaatcagtctatgacg      69300
ctttagtatttgaagttgtgggcagaacttagtcttaagatagcactcaccttggtgatagatttccatg    69370
gagggaatttttgccagatgttaatttagcctgaagatgttatagatgtggacagtcacgccctctaagt    69440
ctggggtgggctaattgaaaagaacatgcaggaaccaggctttgttaagggataaacataggggaaatgta   69510
acaattatggcagagattgaattgggtttaattgggttaggaagagtgaaagaatagatttaataagag      69580
gtctggaaatagccaagaaacccacttattgtagaaaatgtgtgacatctgattaccgtagtgaaagaaa    69650
```

FIGURE 11A-14

```
gatccccttcaaaaatcctatctatacagaaagaagtggtaggtaaaaggaaatcttcccatggatgta      69720
tttaagaaaaacagtggggaggtctgagatttcaaagggccatggttcagattataattcaaaagagagg    69790
caagtgatagttcccctcttcttgggtttcaggaaggggggaagatttggccacttgtgaaataattttgg   69860
agcttctataaccttgagccttcttcttatttttcctggacttgagacataaggggattgataagatg      69930
ggaccagagaaaaagcaggttttgaaatgccttttttgattctgttcatttctggaattcttcatcatgg    70000
tccttaaagagtacatatttgttcctgatacacaacatgcagtggtctattaatgaagctttatttcctc   70070
agctaggttgcctcctccattaatttgtgggattttagatgaaaacttacttgaactgtggttttctctg    70140
tgtttgtgaatggaaggacatgtttgtctttgaccttccttagtttcacatcttagtcttaatatttaa     70210
gtagctttgtttcagacagagaaggaccatgcgttcagttgctgggactgctctctaggttagaggcttt    70280
ctggtcttggggaagattcccccacaaactaagcaagtggcatagatgcttaatattctaagtgagagaag   70350
cactagagttttttattcattacttgtgagcgcagatgtggcctctggggaagctcagctgaggtggtct    70420
catgttccaccaaaggtcaccagagagagatggccaggaagacaggaagacttgtctcacctgggagggt    70490
atggcaacagctatgcaagacctcttgttggagatatgtgacattcattcatttatttattttttgaaac    70560
atagtttcattctttcacccaggctgaagtacagtggcacgatcagggctcactgcaacttccctgtctc    70630
gagctcaagccattctcccacctcagcctcctgagtagctaggacagcaggcaggtaccactctgtccag    70700
gtaattttttaaaatctttttagaaacaaggtattgccatgttgcccaggctggtctggaactcctaggct   70770
ccactcccgcattggcctcaaaagtgctggtattgcagggatgagccttggtgcctggcccatttattc     70840
ttaagtacttatgctcagggcaggtcttccaaggggaagaaaagaacagccagataagactcgtatgagat   70910
agctgaggaggcggcatttcatccttctatgcatatcctccttatccacaagcagaatgctgtcctacaa    70980
ccattgctgtccccattaggtcatgataggtagacatgcaggtgatgaccacagactggcagttagccaa    71050
ggattctcagtgttgcacgttgcatgggtgagtgtgtgtgacggatgcctctggcagtttggtggaaaat    71120
tggtacgttttgtaaaaatgatatgtttaagtcttctaataaggtaaatactcataagaggaagtcagtt    71190
ttattgaaatagttagcacatatattaatattaatcttaaggccaggtgcattgactcattcttgtaaa    71260
tcccagcatttgggatgctgaggtgagaagatctcttgaggccaggagttcaagttgccagcctggaca    71330
acaaagggagactatttctacaaacaataaaataaaaaaaataaaagatatatttaaactgggctgtag    71400
taatacatgtgtatctttattgtatattaagtagctggatctacttatgaggttcatactagtcacaatt   71470
tcttagtacaattgagtttaaacaatattttgggtatttgtcctaccaacattgataatggaagaaaat    71540
actaaatttcagtgcacggtaatgaaactaaacatgtaattccttttcccattgcagttagtagaaccc    71610
atagaatgtatctaaagacaccctaggtggcaaaaggtaaatgcttgagggtatgatacccccattctccat 71680
gatgtgattgcatacctgtatcaaaatatctcatgtacctcataaatatatatacatgctgtgtacccac   71750
aaaaataaataaagaggaaacttggatggggattgggattttttgatgttagggtggagaacgtctgcattg 71820
aggattgtgtagagggaagagtttttgatttattatacccgtttctttaaaaaacaaaacaaaaccaaa    71890
aaaacctgcatgtgatgtgaggaattttgccagagtgtgggaacgtgaaactcactagttgaaaacattc   71960
tatactgaggtaattttttttatgtcaaaaagaaagtgaagagtgtggcagattaaaatcttcatgttatt  72030
tgcattttacaagcttggaagtctcaatatcaattattattgactgctatttactgcaattttgacaca    72100
aaacatacttcattttaatgaactttgccttgtttgaatgttcgtaagactttggagggagttttagaaa   72170
gagatagttgcctttgatccctgaagtatattatttggtctatcctgattctgtctcttgactttgcact   72240
tgtctttcctgaactctgtttaaaagaagcttttttttcttcctcctaatatg                    72310
agatacagaggttttttatgggtaacatcttgtctatatgccagattgtggaagccttggttgttacccag  72380
ggatggaaggtctgatctcagttaagttctgaccctaggataagaagccctctggagtaactgactcag    72450
tggggtagagcctattttcacaaattaatattcctgtctggggatggcagtgaaaacatttgggcagtg    72520
ggtggaaatgataatgttcaagcctgaagatgaagtttgccttttctcggagcttgtacagtgtcatact   72590
ccggaaataaactgtgtggggaaaggtggtgtttagtaacctagagctgtacaccctgcaaggccctcatc  72660
ttgtcattctgcactgtaagaagcacgtgaagaaagagtgtaggcgtgtcagagagagcgtcacactgaag  72730
taggcacttcttacatacagctgtctgcctaaaatagagtaactttagcaaataggatctgtgatataga   72800
aattggaaactctagccaggggtgtgaaaaatggagctggggtcacaggtggtggactggaaaacgttct   72870
gaagaaactcagcttttttggatattgtacagttcattaggggagctatgagaagcagttatgaagctcct  72940
tatgaacgaaacgtagaggccgggtgcctggctcacacctgtaatcccagcgcttcggggctgaggc      73010
gggcagatcatgaggtcaggtgattgagaccatcctggccaacatggtgaagcccggctctactaaaa     73080
cacaaaaattagctgggagtggtgttgcatgcctgtaatcacagctacacagaaggctgaggcaggagaa   73150
tcgcttgaaccagggagttagtagttgcagtgaaccgagatcacaccactgcattccagcctagcaacag   73220
aggaaatctctgtcttaaaaaaagaaacaaagaaacaaaaacaaaagaaagaacatagaaacataccat    73290
cagtgttactcaggagggttctggttcctgttttgcacttggcagtacacacttgttcttgtccacatta   73360
tcctccatctgtccacatgatcaaccatctgcagtcccaccaccagccaagggtcgtgccaggtcagaag   73430
tactactccaggtcaaactgtgttattttgaaatggagttatttgttattgttgttcttactcaaactag   73500
cagtttttcctttgtagaagaactcggtttccactctgggttaaatatttcgtttatgtgatcaagattat  73570
ctctgtccatcagatacagcagtgagaaaccctttatagggaaatgggttaaaagtgacaggatatcta    73640
taattgtttattttgtttgctaaattgcaggtaaatatattcgcagaactagttttgataacctttaa     73710
aaataggcttatttgacgttggctgaaactaagactctagaactttactgctacatcaatgaatgacaag   73780
tctctctattcagcatgaaatccctgcagacaaaaaccacagggactacatcatgaaggctatgagaatt   73850
ttatggtggaaacctgagtgaagcaggtggtagaagaatctaatgtagtaccatgcccacaggagatgat   73920
ctaagaatgccctcacacctaaccttgcaagtttctaccttctgtgtttggttcctctaatttctttt    73990
gtctcttttctccttttaatttaataggggtttgctgaagacttctctcttccaaggtcaagtgttagt    74060
catctctgggctttgccgttagatactcatcatagtctaacaatgaatgtaagcactgaggaagtaagta   74130
atggtgacaatgtggatgttccttttggtatcattttttctcatgctctgtaaatcttggtggtctcatat  74200
tcatattattgaataccaatgcttaaccctctctgccgtctttacagaagtccctggtctacctctct     74270
ctacgtgtctaaaattgtagaattgtcttctagacactctattgcaaattccctctgcacaagccaac     74340
atttcacagaaggagcaggtgggggcaatgaaagagagcatggctcaattgtagcaattgaaaggcaag    74410
ctttgtctcatcagctgcagtgtttactacttgaggatgggaattttgattggtgtatcttttacattttat 74480
caaagtgggtttcaccatgaagcattcagtggtacctcagtgaataattataattagctaggatttctt    74550
tgaggatatttattgttctaaatttgtatatatttatatgtacatactgtattagttcattttcatgct    74620
gctgataaagacataactgagactgggtaatttataaagtaaaagaggtttaataaaactcatagttctt   74690
gtggttgggaggcctcacagtcctggcaaaagcaagggaagaacaaaggcacatcttacatggcaacag    74760
```

```
gcaaaagagagagcttgtgcaggggaactcctctttaaaaaaccatcagatcttgtgacctcatagttc      74830
acatgagaacatgacaatgaataagtcatgggtggaaactgcccccatgtttcaattatctcccactggg     74900
tccctcccccttacatgtgggaattatgagagctacaattctagatgagatttgtgtggagacacagccaa    74970
accatgtcacatacatatgcatatctttatgtagggatctttatgtaaggtatgtgaatacaggtgtgt      75040
atattcatatactcttgtactttctcaaacacataccatagaatgtgtaataatgtgtctggaattggt      75110
ggttcttggtctcactgacttcaagaatgaagctgcggaccctcgcggtgagtgttatagctcttaaggt     75180
ggcgcgtctggagtctgtcccttctgatgttcagatgtgttcagagtttcttccttctggtgggttcgtg    75250
gtctcgctggctcaggagtgaagctgcagaccttcgcggtgagtgttacagctcttaagatagtgcatct     75320
ggagttgttcattactcctggtgggctcgtggtcttgctgggctcaggagtgaagctgcagatcttcaca     75390
gtgagtgttacagctcataaaagcagcgtggacccaaagagtgagcagtagcaagatttattgcaaagag     75460
caaaagagcaaagcttccacagtgtggaaggggacccgagtgggttgccaatgctggctcaggcagcctg    75530
ctttttattctcttatctggccccacccacatcctgctaattgtagagccgagtggcctgttttgtcaggg   75600
cgctgattggtgcatttacagtgcctgagctagatacaaaggttctccatgtccccatcagattagttag    75670
atacagagtttcgacacacaggttctccaaggccccaccagagcagctagatacagagtgtcgattggtt    75740
cattcacaaaccttgagctaaacacagggtgctgattggtgtatttacaatcctcgagctagatacagag    75810
tgccgattggtgtatttacaatccctgagctagacataaaggttctccacgtcctcaccagagcagctag    75880
atacagagtgtcgactggtgcactcacaaaccttgagctaaacacagggtgctgattggtgtatttacaa    75950
tccctgagctagatataaagactctccacgtcctcacaagagcagctagatacagtgtcgattggtgcac    76020
tcacaaaccttgagctaaacacagggtgctgactgatgtatttacaatccctgagctacatataaagatt    76090
ctccacgtccccaccagactcaggaacccagctggcttcacctagtggatcccacaccgaggctgcaggt    76160
ggagctccctgccagtcctgcaccatgcgctcacattcctcagcccttgggtggtcgatgggactaggcg    76230
ctgtggagcatgggtggtgctccttggggaggctcgggccgcacaggagccatggagtgggtgggagg      76300
ctcagacatggtgggctgcaggtcctgagccctgccgcatgggaaggcagctgaggcccagctagaaatt    76370
gagtgcagcgccagtgggccagcagctgtggggactgctcagtacacctctgctgccactggcccgagtgc   76440
taagtcccccattgccgggggccagcagcgctggccggctgctccgagtgcggggcccgccaagcccacg     76510
cccacccggaactccagctggcccacaagtgctgcacgcagccccagttcctgctcactcctctccctcc    76580
acacctccctgcaagctgaaggagtgggctccagccttggccagcccagaaaagggctcccacagtgcag    76650
tggaggggctgaagggcccctcaaatgccaccaaagtgggagccaggcaggggaggtgacgagagccag     76720
cgagggctctgaggactgccagcatgctgtcacctctcaatccccccctctaaacaggacaccccaactgc   76790
tgtgggaatttggccaatgaccgcttggctacttcctgctgcataggggtgaagaaggggccctgaag      76860
ttgtggtatccttcagaggggaactctctaggccaggggaagtgccagcaagtcggtccaggggtcctcg    76930
gtagaagttgttagttgaactcatttgggggttccatttgtaagaccatctgtagcttgatggcctcaatt   77000
ctagaggaaacaaacttgacaagaaggttaaaaatacaagggcccaaaggcgagtaacagcaagatggctg   77070
ccacaggacctagaaagggagaagccatgttgcccaactccagaggttggtataagaatttgaaaggcg     77140
ttgtctgatttcagaagcctttccagtaaacgccgggcagcatctcgtactatccctgattagttagtg     77210
taaaaacaacactcttcccctaagaaggtgcagagtcctcctttctcagcagtgaggcagtctagacctc    77280
ggcggttttggagagtcactgctgccaaagagtctatttgggattgtaaagtaagaagattttgttattt    77350
cttgcaaactatctgacaaatcgtttgagagtgtgtggtagtaggataatgaagttgatagaccagctat    77420
tctgttcctgtagcagtagccattcctaacactataagtaggggtattagttgtacggctctgcgctga     77490
cggacttgagctttgaggggtactgataaggtctgatttcctgggacaatgttaatgttaggacttagaa    77560
agactaaggtgcatgtgcctgtccagttagtggggaggcagatataggttgacattccacataagaagaa    77630
tatgccttggctgggtagacagaactggttatgtatgttaaaaaaggtgtgtgagtttgttgttttcatt    77700
ttcccatactacttgccaaggtacctccagtgagcagctggaaagggtgttgggagaaaac             77770
tgagtggctccctgtgttctatttttcccatcggagaaaaaatgttttgtatccactaggaaccatctga    77840
tagagtgattgaaagaggggatgagaaggcattcactagtggtaggggcgctgttgcagggagtccaggg    77910
gtgattggtcatgcaggagtatgtttgccattgcaaacctggactgtttgttcaccaggggaggaggtg    77980
atgatttggggggcactgagaagcagagaaggcatcagaatgcagctgtttgggtgactcaaaagttac     78050
tatgatcatttggagcttgaagttgtaaggtgtaattacactcatgatgcgttggtaggtgcgcagaggcag  78120
gcctgataacaggttgcattggatgcataaaggggcttggaaagttaagatagtgttcgtggttacaagg    78190
cttttcattgcttgtgtaataggtgaggttgaaatgtaagaacataaaatttgggttgcacgtcctgtt     78260
agggtactttggtcccatcagatattgggaagtcagccaatgattgcatatttagaagttggaagggt      78330
cttttccttcgtaacgtaggtggaaggtcaagttggtaaagacccagtttttgcaggaatgggagtggc     78400
aacgtaggcagaggttgatagagagatacacagccaacagtcatttgccagggaagtattggactggttt    78470
aacagagtgtgagttaagttgagagtcttgtagaggtaattaggagctagtgaaagggaggggtgattg     78540
tatgaggttccaaggaagcaggagggatacacaggcaaagagcaaataggaaggtaaagagggtgctcc     78610
agaaaatgagatcattttatctagtctgagttagaggtaggagtaaattactgtcaaaaggaaggaagat    78680
agaaaggaggttgatgtgattaggattttcattctggcaggagctagagtatattgtcctatcacaaaga    78750
gtatggttagtgtgctgttttcacttatctttttaaggaggaagaggtctttcctcaggatcagtggta    78820
ggagccttttagtctgggatgttccttctgaaataagaggtgcaagtcctccaacggttcgcaggtgt      78890
atcgaagctggtctggctgatcttgggactcctgagctgatgatccagcaggttcctcaggagatgtcca    78960
aagtttaactggggtgtggtgaatccaagtttccactcctgcctgccatgttaactgcaatgggagtagagagg 79030
attatagagtatgtccttcccacaaagagtccatagatgggaggtagagggaagagatttgaccaaca      79100
ctagatctcctggttgaaacaactctgttccctgttctctgtgacatccttcaggtagattttaaggtt    79170
ttgttgatatttgccaaagttatatctttgacaaagttggccatttcctgattgagtaggaggtcattt    79240
gtgagaaaaggtcgcccatacagcatttcatatggactgagcccctattttgtggggagaatttcgaattc   79310
tcaacaaggccatgggcaaaagagtaggccatgggagtgagttcttgctgttagtttccttaagtgcct     79380
cttgagtgtttgatttgccttctcaaccttcccagaggattgtggcctccaggagcaatgaaggcgatat    79450
tgtatccctagtgccttggagattccctgagttatcgtggctttaaagctggaacattctcactctgta    79520
agctttggggaagcctgaatctaggaattattaggactttaatcacttcctgagccttctctgtcttgta    79590
agagaaagcttctatccaatttgtaaaggtatcaacacagaccaacaagtattgaaatcccttgactta     79660
ggcatatgggagaagtctaactgccagtcctctccggagatagtgacctattcttttgttccccacaggg    79730
cctttatgatataccaagggataattcttttggcacacctcacaggctttgactacctgtcagatggtctg   79800
gaggagatttggccctgtaaataggatttggccatttgattagtgttttcaataccatatgaaaagtt     79870
```

FIGURE 11A-16

```
tggtggagggtcttaagtatttccactggctgccttccggtataagtacctttccttcttctgtcacca        79940
accaccctgaaggagaaaactatgccccatgaaagtccccattctgtttcagtccgggaatactgggg        80010
cttcatctcctggaggggttgttccataccaagggtccttccataggcatttctaatgggacattcctc       80080
ctggcagcagctttgacctcagcatctgcctgatggtttccttctgccttttctccttcacctttctgat     80150
ggctttgtcagtgtaagattcccacctctttgtgtttttcactgtgtgactgggcgggcatttttttgc      80220
cctttcagattgtccttccaatgcccagacttcagggttgattccctcctcaagtaggggacaacaaatg     80290
ggtaaattgttccccatattcatgtagataatagcctccagccttggctaatatatccctccctaataagg    80360
gtgtgggactttcaggcataacaagaaaggcatgtgaaagagcagagtctcccaattacaactgaggag      80430
atgggagaaatacctgattacaggctgccccaggattcctcagatgtaactgacccttgaggacagtcgt     80500
ccaggacaggagattaacactgagaaggctgtgccagtatccaggaggaagtcaatttcctggtcatcaa     80570
tagttaaacatacctggggctcagtgagggtgatgacatgagctggtgctagcccctggcaccctcattc     80640
cttctgttggatcatctggttgggggcttctgacccaggaaacttcatcctctggggcagtgcaccttc     80710
cagtgattgcctcggcatagtggacacggacgaggggcagcttgtttcttattggacaatctttttaa      80780
aatgtcgtagtaaacggcactgataacaagccctaccaggtgattggcctgctccattttctgacctctc   80850
tgaaccaccaaagtttgtttgtctgagggccaaagctgctgtggcctttctctgatctcgcttttcc       80920
ttttgggcctgttcttcttggtccctattatagaacactgaggttgccaggtttaataatgtctctagat   80990
tttgttcagggcccagggcttgcttttggagctttctcctgatatctgcagctgatggattgggtaataa   81060
acatatcttttagaatcaattgaccctcaagtgattcaggtgacaggggagtatattttcttaaggcctc   81130
tcgtagccgctcgaggaaggcagaaggtttttcttccttccctgggttatggtagatatcattgaataa    81200
ttcatgggcttttttctaattctccttagtccttccagaacacaggtcaatagatgtttacaactccagt   81270
ccccatgatctgagtcaaggtcccagtggggatccgtactggggatggcttgctgaccagtagggaattt    81340
gtccctttcttcagctgtcattctatcatttacttgactaagacaccaggtatctccaaactcctaggct   81410
gcagctaaagccgcattcttttcattaaaggccagggtttgaactatcagtagcatgacatctctccaag   81480
tgaggtcaaaggtttgccctagatgctgtaggacatctatgtacctatcaggatcatctgaaaacttccc   81550
caggtctgccttgatctgctttaaatcagagagggagaaggggacatataccccgggttgggccaaattcc  81620
cctcctgctacagattgaaggggacataaccgacagcccgggggttttgtggtcctttggagagattctt    81690
tgcttgtttccttccgggcaggggagattagaggaggagtatcaataataggaaggggagctataggag    81760
gctaggatataggggtaagctgaggggtcctcctctgggatgtaaattgcaagctttgcatagttgtgta   81830
ttctccctcaatgaaaagaaagctcggacataaggcatttcactccatttgccttccctcttacagaaaa   81900
gatcaagctgcaggatagtattgtaatttgtacttccctcaggtggccattttccccatctgcttgtcctc  81970
atattgggggccaggccgcagtgcagaaaaaaaatgagctgcctcttttcagggtttgtgggtcaaattg    82040
gtcccaatggcttaggatgcatttcaagggtgagcctgttgatgcctgagtgtttcccatctgaaagaca   82110
aaattacccgcagttttggtttgttttgtttctctccctgtccaagaacccgcaacggtccctggaccct   82180
gctgatcggaatagttgcactcactgacgcagcaacagaaacactagttttcctcccagaccacatggag   82250
gaccgaggaaggtcggatttagtggtcctactgacgcaatgttgaaaactgcacccttgcttgtcctc     82320
ctagaccacaaggaggaccgactgagaaaaatcggatttagtggcccttaccaacgcatcctcaaaaacc   82390
tgttagagtcctaagcgttctcctgttagtattaggactttaccccctgtcctataaagatgttatgcccc  82460
aaaaatgaaatggagggccatacccctgagggagggaagggatcttcatggttggaagagtgacacctttt   82530
gtcctcacttataggaaggatacaatttctgaggctcccccatatcctagcttcaggaataactttttgtta 82600
ggcctgttagtctgaggagggatcctaaaattccaggtagtccccactatgtgggccttgggcaaaaa     82670
ctgtatctttctgattggtgagcccgggtgcctaaagaagataaacagagtcctggagtttatactagaag  82740
tcattcttataggagaaacaagaaaagcaccagaggcaggtagcaatttttagaagcgggtctagactca   82810
gaagagaggcgagaggaagtttgtctggcaggcattgggacccagagggcaagggtcagtatagataagga   82880
tagataggcgagtctcgcttgggcgacatgcttgagagttccgctcatggctgcaggtcaaccaacatg    82950
ttgttgggaccccggagatgcatggctttcctctctgtcgactccggctcagcccagaagtacagaaaa    83020
agcagaagctggttctaggtaaaacaacgtcccaactccaaagagttgggggttgttagagagcccttt    83090
cccagaaagcctgacaccgcgtctttagtctggcagccacactagttgcctttaactggctgacaggtg    83160
cctggtatttagccccgaattctaaggaaagataggacaatatagcaagcgaaaggggtccaatggtac    83230
tcactgcttggcgataggtgatggtctcaccgcttggcgattgtctcaccgcttggcaataggcgatggt   83300
ctcactgcttggcgataggcaaaagtccctctgttggtccacaaaatgtgtctgaaattgctgggttcttg  83370
gtctcactgacttcaagaatgaagctgcgtgaacctcatggtgagtgtttacagctcttaaggtggcacgtc 83440
tggagtctgtcccttctgatgttcagatgtgttcagagtttcttcctttctggtgggttcgtggtctcgct  83510
ggctcaggagtgaagctgcagacccttcgcagtgaatgttacagctcttaaggtagcgcgtctggagttgt   83580
tcgtttctcccggtgggctcgtggtctcgctgggctcaggagtgaagctgcagatcttcttcacggtgag    83650
tgttacagctcacaaaagcagcgtgaccccaaagagtgagcagtgacaagatttattgcaaagagcaaa    83720
aaactaaccttccacagtgtggaagaggaccggagcgagttgccaatgctggctcgggcagcctgctttt   83790
attctcttatctggccccatccacatcctgctgattggtagagccgagtggcctgttttgtcagggtgct   83860
gcttggcgcgtttacaatccctgagctagatacaaatgttctccacgtccccatcagattagttagatac   83930
agagtttcgacacacatgttctccaaggccccaccagagcagctagatacagagtgtcgattgcttcatt   84000
cacaaaccttgagctaaacagagggtgctgattggtgtatttacaatccttgagctagtagagagtgcc    84070
gattggtgtatttacaatccctgagctagatacagagtgccgattggtgtatttacaatccctgagctag   84140
acataaaggttctccacgtcctccaccagagcagctagatacagagtgttgattggtgaactcacaaacct  84210
tgagctaaacacagggtgctgattggtgtatttacaatccctgagctagatataaagactctccacgtcc   84280
tcaccggagcagctagatacagagtttcgattggtgcactcaaatcttgagctaaacacagggtgctgac   84350
tggtgtatttacaatccctgagctagatataaagactctccacgtcctcacaagagcagctagatacagt   84420
gtcgattggtgcactcacaaaaccttgagctaaacacagggtgctgatgtgtatttacaatccctgatc    84490
tagatatacagattctccacgtccccaccagactcaggagcccagctggcttcacctagtggatcccgca   84560
ctggggctacacgtggagctgactgccagtcctgcgccatgcgctggcattcctcagcccttgggtggtc   84630
aatgggactgggtgccgtggagcaggttggtgctcgtcggggaggctcgggccacacaggagcccatgg    84700
agtgggtgggaggctcagacatggcgggctgcaggtcccgagccctgccccgtgggaaggcagctgaggc    84770
ctgctagaaatccagcgcagcgccggtgggcagccgcgtgctggggtactgtacccctccacagcca      84840
ctggcccagatgctaagtcccccattgcctgggggccagcagggctggccggctgctccgagtgcccgggcc 84910
agccaagcccacgcccacccagaactccagctggcctgcaagcacagcaggcagcccggttcccgctca    84980
```

```
cgcctctccctccacacctccctacaagctgaaggagtgggctccagccttgtccagcccagaaaagggc   85050
tcccacagtgcagtgggggtactgaagggctcctcaaatgccaccaaagtgggagcccaggcaggggagg   85120
tgccaagagcaagcaacggctctaaggactgccagcaatgctgtcacctctcaataatatccctgaatta   85190
catctgctactccgctgctctacccatctaacaagtaagtgatggagacattgatggttctattagtcag   85260
ggttctctggagggacagaactaataggagatgtatatatatatatatatatatatatatcgctaacc    85330
cttaccataacatatatatgtgtgtgtgtgtctgtgtgtgtaaaggatatacaaatatacatacaact    85400
aataggatatatgtatgtgtgtttatatagataatatctatgtttttatataaatatatataaattatgt   85470
atatgaatataacaaaatatatatttatatatagtatatataaacacacacacagatatatatcctatta   85540
gtgataagtgataaagagtagtgtttatatatatacatatatataataaattcttctttatatatatata   85610
catctatatttgtgtgtgtgtgtgtccatatatatatataagtttattaagcagtatgaactcacgggat   85680
ctcaaggtcccacacagtagacgatctgcaagctgaggagcgaggaagccagttagagttccaaagctga   85750
agaatttggagtctgatgttccagggcaggaagaatcaagcacaggacagatgtagacttggagggtaag   85820
gcagtcttgtcttttcacgttttctgcctgctttataatttctggcagctgatgagatggtgcctaccc   85890
gcttgagtgtgggtctgccttccccagcccactgactcaaatgttaatttcctttgacaacaccctcaca   85960
gagacacctgggatcagtactgtgcatccatcaatccaatcaagttgacactcagcattaaccatcacaa   86030
tggtgtacaactgactggagttaaagtgagagtcaggctttgaatcatagtcgtaaaactgcacaaattc   86100
tctgccccatactacctcccagacacataatacatgcaggagtaggtgttttttgtgcctgttatagtgca   86170
tttgagcctgttgttctttactttgctcttgtgtcagaccatctctccaaaaacagatgatcagcatcat   86240
acacaactggtagtattgattatctgcagcataaagcatggaacatgggattttcagggaatggagtagg   86310
aaaaattcctgaacctaagcagcttaatacccttaatatttcacttggttagtttgaatacatatacttct   86380
acacacacacacatgaaattacatggataatataagctttaatgtattgtatatataatataaatctctc   86450
taacctccaaaaatgtatatatccaaactatttgtcaatttctctctctctttcccccctcttgctcttt   86520
ccacatatttatgtataaaacagttttttcaaactaaccaactgaaatattaagctcctatgtcctatata   86590
taatatatatttctgcaaataaccaaaatatcaaagcaattaagctcctgtttcatgtatctattgtata   86660
tagatatatgtgtgtgtgtgtacatgtatacagtatttctccaaactaagcaactgaaaaatattaagct   86730
cctatgtcttacatatataaaatatttattcaaataagcaagcaaaatattaggctattaagctcctatg   86800
aataatgttttattttattctatataaatagaataatatgaatatgtttcatattattctgtatattata   86870
tatatatacacagcaggttagtttgaagacatgtatgcatatattaaaatctactttataatttgatata   86940
taataagttaagtacaaactttcatgaaatatgtatgagaagaaggaagactattttttatagtacgatta   87010
gtacagtgaattctggggaaaaagtaaatactcatttcaaatcctcatgtacaattcaaataaacaaaaa   87080
tctggtggcatgtttacagcctgctaatatagattatgtggtgttggaaaacattttattttttacaagta   87150
cctagtaggtgtatatatttgtgggttatatgagctatttcaatataggcatacaatgataaaaatcaca   87220
ttaaaataaatgggggtacacatcacctcaagcatttatcgtttatttgtttttacaggcttttcatttatac   87290
ttttagttatttaaaaatagtcagtaaattagtgttgactgcagataccctattgtgctatgaaatacta   87360
gatcttcttcattctgtctcactatattttgtgcctattaaccatcccccacttctctatccctcccatt   87430
actctccccagcctatggtaaccatcattctattctctgtccctgaaggcaactggaaggctatttt     87500
ctttttttctttttctttttttttttgagacagagtctccctctgtcacccagaatgatgtcgcccagtg   87570
atgcagtctaggttccctgcaacctgcccccttgtgggttcaagtgttttttccagtctcagcctcccaagc   87640
agctgggattacaggtgcacaccacctcgcccaccttaattttggttgtttttttttttgtagacacagggt   87710
ttcaccatgttggccaggctggtctcgaactccttacctcgtgatccacccacctaggcctcccaaagtg   87780
ctggaattacaggcgtgagccaccacacctggcctgaaagacatattttttaaaggataggctggaaggtt   87850
gcattgactttcgctgtttctggctcactaaatcctgctattttctgcagtagggattgctacacttacg   87920
ttatgctttcctactgcagagaaggacattctgttcccactgggctcctatactgcctctacagtcggct   87990
ttggagataacagcctgaggcgtcagagcgtcttggtggtgaaagcatcttaagatgtcactggcacggc   88060
tgggtgctgtggctcacgcctgtaatgctagcattttggaaggctgaggcgggcggatcacgaagtcaag   88130
agattgagaccatcctggccaacatggtgaaaccccatctctaccaaaaatacaaaaattagctcggcag   88200
tgcctgtagtcccagctactcgggaggctgaggcaggagaattgctttaacctgggagcagaggttgcag   88270
taagccgagatcgagcaactgcacttcagtctggcgactgagctagactcggtctcaaataagggggtta   88340
aaaaaaaaagagtcactggtacaagcccttgtttttgcagtggaaggagatgaagtccaggccactacat   88410
gatgggccagagagcacgtggcttattagtgaccacggctatagtggctcaagttccctggctgctggcc   88480
atggctggcaggatcccggggcttttctgcctaatacgtgggtctgttgccttgggtgtgttgcattggg   88550
cttgtcgcataatcatggagaaatagattttctcttcaattttttaaatccaagatatttttggcagcacat   88620
gggaaaataaagtcattgagtaagaaaacctatacagatgagcattttgattaaattttcattataaa    88690
ataatcacagtcacaaaacctgaatcaaaacgtatacacagataatcatcttaaagagtaaaaaataatc   88760
aggtacatagtattgtactcactgacagaccaggaaagagcattcccactgttttttgtatatcagtgtga   88830
gtttgcttcctgtctcctacctcgcagagaaatgtacttcctcaggattcggttttcagaatgcccttgc   88900
tatgttatttcaggacaaacatagttctgagcaatatattgtttagttttacccttatgtaaatgaaaat   88970
cacactatttgtgtgttttatggcttggcttttatgtttgaggtttttcccattttggtccatatatctg   89040
tattttattcattttttactgttgtgtaaagctttctgcttaatatgccaacatttatttattcattgt    89110
cctatttatggatatctggattgtcgtaactttttttgcaattacaatttgggttgcattgtcccccagca   89180
aactaatgcagggacagaaaaccaaacactgcatgttctcacttataagtggcagctcaacgatgataac   89250
atgtgaacacatgtgggtggagaacaacacataatgtggcctgtctggggatttggaggaggggagaaca   89320
tcaggaagaataactaatggatgctgggattaatacctaggtgatgggttgattcgtgcagcaaataaa    89390
atggcacatgtttacctgtgtaacaaacctacaaatcctgcacatttaccatgaaaattaaaataaaagt   89460
tgaagaaaaatattggggctgcaatggacatttctgtacatattttctgatgcaaatattttagaaacc   89530
ctatagaggatggatgtgtgtgtgtgtgtgcgtggtgtgtgtgtgtgtgtgtctactttcaccatagg    89600
attctgtatcttctactttctaatgtgatttaaaattgttttgcagtgggggttgcacagaggctcagcat   89670
cattgcatgtagttgctccagatctttcttcagtagttgatatcattgtatcaaattttttatt         89740
aatactattctgatttcatctgcatttcaccaataatgaatggcattgagcctcttgtcctatgttgagg   89810
ctatctgtagatgtgaggacttcttccttgatacggatttatggtggaggaatcaatcaccaaagatggc   89880
tctgagtgtaggctgaatgactaaaaatataatgatctagttatctaaatataaaacaaaattgtttaag   89950
caatttgggggattggagaatgagagttttaggagaaccataagatatctatctgactatattcttcaag   90020
acaagatagtcatggcagtacaggcatggtggcacataacatttttgtcacctggcactacacgagtgtgc   90090
```

FIGURE 11A-18

```
ttccatgaccttgaggatatatatgactttgagtttggtgagacagatgaacacaaagcccagagaatct    90160
gcaaattatttgacttagatttagatattgtgtttggaaaacatttgacacagaaaatcaagcattagca    90230
agcatttattatttgcttgtgttagctttagttatgcagatgatgaataataagaaaaaaagcatcacag    90300
gtagggatagatactgtcatgaaaatttaagcttctcatgggcaggaactcattcttaaccccactatgt    90370
gcccttactaagcgcagtgatctttatgggatacttctatgatctgaagacttgtgtccttccagaatcc    90440
acatgttgacattgtaaacccaaagtgatggtgctaggaggtaggggctttggagctgccgagatgttga    90510
gagtggatgccacgtgaatggcattaatgacatttaaaagatacccccagggacattacttgctcctccc    90580
ctcttttccaaagtcataaggaaaagtcagccctctaggcattgggccctcaccatacactgaatctacc    90650
atatcttgatttcggatttccagtctccagaactgtgagcaatgaatctctatggtgtataagcccccacc    90720
accacccgccccaacgacactcacccaggctatgatattttgttacagcagcctgaatggactaaccca    90790
acttctgtgcttgctgttgtcttatttctttggtcagtgtaggatcttgctgtccgcatagtttgctct    90860
agaaagatggatgctctattcctaatggtgtatttggccttcctatctatggaatattctcctatccaat    90930
cagtcttggtaacatataaatgattaactctaccctttgggtatagttttggttctgctaagtccccctgct    91000
gaaaattctggtttctaccattatggctcatgcatgttcctgacccattaaacttcagtggaagaataga    91070
aatggagagggaggtgatggagttgatatcttaaactgcaatatggtgcaagcccatcttgcagataata    91140
tatttggtgtcttccttatcttttaagagcggccttgctatgttgcctagcctaaaatcaaactcctgg    91210
gcaagtgatgcttgtggctcagcctcccaattacctggcattacagacatgtaccaccatgcctggccac    91280
gttttactctccaattacttaatatatagtaaagctaatggttcacagtggttcattttttgtgtgta    91350
ttccaataacattttatttatttattaccttgaacatattcaatatttatttgacaagttttttataattt    91420
taacattttttttttaattcatgtggtatgagtgtaagttttttttctctgggtgtattggatggtgctgag    91490
gtttgaggtgcagatgattctgtcatacacctatggagcatggtacacaataggtagttttccaacttta    91560
ccctctctgtcacccctatttagtagtcctgagtttctgttattgctttatgttcatgagtatccaatgt    91630
ttagttcccacttataagtgagaacatgtgtatttaacttttctgtttctgcattaatttacttaggata    91700
atggcttccagctgcatccatgttcctgcagaggacatgattttgtttgtttttatggctgaatagtatt    91770
ccatggtatgtatgtatcacatattctttattcaaaccaccattgatgggcacttaggttgattccatgt    91840
ctgctattgtgaatagtgctgtaattagcatacgtgtgcatttgtcttttttgttagaatgatttattt    91910
catttatatatatatataaaacaattaatgggattgctaggtctgtggtagttcctcttaagttccttga    91980
gaaatctccatactgttttacacaatgcatttcaccaacagtatatgtagccttctcttc    92050
tctgcagcctcaaagacacctgttgtttttgatgttttatgaacagcctttctgactggtgtgagttttt    92120
gatttgcatttctctggtacaaaatggtggattttgaaatgagatttgatttctaaattttatagaaact    92190
gcatagatgactgcaaagaactcttaagatatgacaaaagacaaattagattgtaatctcctttataca    92260
ggacaagaaataaagaggagaatattaaaatatgtacacatacaaaagtagatgaattggcgattgttgg    92330
tgttggatgcatgttaagcagggtggaaggaggtgtgtgtgcatgcatctcgtggccatgtgttgagagtgg    92400
gcatccatgtaggtaacagcagagagctttgggggttcagaaaaaaagataagtcacatcccactcaggta    92470
ccctaaaatgttgtcttctctagaaatgaaagaagagggaagccagagatgtctgtagcttgcatagttt    92540
tgggaatagctattctagactttgtcagtgaacagcatagaaggattgttgttcaagcccagttatttgg    92610
gcaaggatcagattctgttgcttttgttttctggatgctccataatgaatgtgagatagaagcagatgtc    92680
tcaagtgcttcttgttctcagaaacctcctgacagcagatctcagtgggcccagaccttcagtgtgtc    92750
tgtaagtaaaacaggggagggtgctctttctgatttatcttactattttaatgcaattacaaagcttc    92820
ctatttctaatatattccaagcctttgaaagacaaggccataaacacccaggatatctgattttattca    92890
tgataagacccaaataccaaaatacctatgatcagggctcaccttaattaagtatgtatcttaaaattaa    92960
accaatctcagtttgaggaattcatacttttggaagaaatttattacagttttttgttctgaacattatat    93030
tatgataggcttgaatagtgtgagccttgctataattacaacctgagtcacaataacttccctgcagagg    93100
atgatttaaaatacccaatcaatttatgaactggtcaaaaatgccattctgaggtatttttttttatgca    93170
gtcttgcagagaagacatgccatatagtccttcttcattcccaaagcatatatatatatacgtatatac    93240
acacacacatatacatatacatataaatatacagtgaagttagttttttacctttgttatcaatatttttt    93310
atccatcaaaaatttataaatgatttgtggcatccccttttatcttaggaaaattaaaaatctctcta    93380
tcaacttatctatgaataaccacatttcatccccttgtaaatcattttagtttgtgaaactcacattgg    93450
agatctttttatttttttgcccgcaaggatgtaggctggttaaattacagagattcttaatgatgataat    93520
gtacatttgactgatatcaataagaaatattgatattattaatatcaacatttttgcaatgctaaaat    93590
ttacaagttgtcgaattatttaattatttattttattatacattaagttctgggatacatgtgcagaat    93660
atgcaggtttgttacataggtatacatgtaccgtggtagtttactgcacctttcaacccatcatctaggt    93730
tttaagccttaaaaccttaagcattttggtacttgtcccagtgcatctttacctttgcacccccatcccc    93800
caagaagccccggtgtgtgatgttccacttctccatgttcatgtgttctcattgttcaactcccatttt    93870
gagtgagaacatgtggttttttgctttctgatcctctgtttgctgagaataatcatttccagcttcatcc    93940
atgtccctgcaaaggacattaactcattcttatttatggctgcatagtattccatggtgtatgtgtgcca    94010
catttctgtatccagtctatcattgatgggcatttggtttggttccatgactttgctattgtaaatagg    94080
aatgcaataaatgtgcatgtacatgtgctttataatagaatgatcaataatcctttgggtattgtaccca    94150
gtaatgggattgctcagtaaatggtatttccagttctagatccttgaggaatcgcgacactgtcttcta    94220
caacggttgaattaatcgacactaccaccaacagtgtaaaacattctatttctccacatcctctccaaca    94290
tctgttgtttcctgactttgaatgattgccattctaactgggggtgagatggtatctcattgtggttttga    94360
tttgcatttctctaatgaccagtgatgataagcttttttcgtatgtttgttgactgcacaaatgtcctc    94430
ttttgagaagtatctgttcataaaccttacactttttgatggggttgtttgttttcttcttgtaaatttg    94500
ttaaagtttcttgtagattctggatattagcccttgtcagatggctagattgcaaaaacttctcccat    94570
tgcctgttaactctgatgatagttcctttgctgtgcagaggctcttaattagatctcatttgtcaatt    94640
tttgctttgtttcaattgtttttggtgttttagtcatgaagtctttgcccatgcctatgtcctgaatggt    94710
attgccacattttcttctagttttatgatttttctcttatggttaggtcttaatccatcttgagtta    94780
attttttgtataaggtgttaagaaagggttcagttttagttttctgcatatggctagccagtttttcccaat    94850
accatttattaaataggacatccttctcattgcttgttttttttcagatttgttgaagttcagatggt    94920
tgtagatgtgggtgtatttctgaggcctctgttctgttccattggtctatatatttgttttcttaccag    94990
taccgtgctgttttggttactgtacccttgtagtgcagtttgaagtcaggtagcatgatgcctctagctt    95060
tgttcttttttgcttaggactttcttggccatataagctcttttttagttccacccgaaatttatggtgtt    95130
tttctcctttttttttttaatactgtgaagaaagtcactgttcgcttgatgagaatagcgttgaatttaaaa    95200
```

FIGURE 11A-19

```
actactttgggcagtttggccattttcacaatattgattcctcctatccatgagcatgtaatgtttttcc     95270
atttgtgggtgtcctttcttattttcttgagcagtggtttgtagttctctttgaagaggtccttcacttc     95340
ccttgtaagttgttttcctgggtactttattctctttgtagcaactgtgaatgggagttcactcatgatt     95410
tgtctctctgattgtccattattggtgtataggaatgcttgtgattttttgcacattgattttgtatcctg     95480
agattttgctgaagttgcttaccagcttaagggggatttggggctgagacaatgcaattttctaaatattc     95550
aatcatgttatctggaaacagagataatttgacttcctctcctgctatttggatatcctttatttttcct     95620
cttgcctgactgccctggccagaactttcaatactatgttgaataagagtggtgagagagggcatccttg     95690
tttgtgctgattttccaagggaatgcttccagcttttaccaattcagtatgatgttggctatgggtttgt     95760
cataaatagcactcattattttgatatatgttccatcaataccctagtttattgagtgtttttagcatgac     95830
gttgtgttgaaatttattgaaggccttttctgcatctattgggataatcacatgtttttttgtcattgtt     95900
tctgtttatgtgatggattatgttgattgatttgcttatgttgaaccagccttgtatcccaagggatgaa     95970
cccgacttgatcatggtggataaaccttttgatgtgctgctggatttggtttgccagcatttttattgagg     96040
atttttgcactgatgttcatcaggaatatttgcatgaattttcattttctgttgtatctttgtcagttc     96110
atggtattaggatgatgctggcctcataaaatgagttagggaggagtccctgtttttctattgtttggaa     96180
tcatttcagaagaaatggtaccagctcctgtttgtattgttggtagaattcagctgtgaatctgtctggt     96250
cctgggcttttccacttggtagtctattaattaccgccttaatttcagaacttgttattggtctattca     96320
gggattcagcttcttcctggtttattcttgggagagtgtatgtgtccaggaatttatccatttcttttgg     96390
tatttccgtagaggtgtttatagtattctgtgttggtagtttgcatttctgtgcgatcagtagtgatatc     96460
cccttaatgttttattgtgtctatttgatactttctctttatttttattagtctggctagcaata     96530
catctattttgttaattttttccaaaaatcagcttttgattcactgattttcttgaaggattttttta     96600
tgtctttatcttcttcagttctgctccagtcttagttctttcttgtcttccactaggttttaaatttgtt     96670
tactcttgcttgaatagttcttttaattgcaatgttaggggggttgattttacatcttttcttgctttctct     96740
tgtggtcatttagtgctctaaatttccatttgaacactgctttaaatgtgtcttagagattctggtacat     96810
tgtatctttgttcttatcagtttcaaagaacttatttatttctgctttaatttccttatttacccggtag     96880
tcattcaggagcaagttgttcagtttccatgtagttgtgtgggtttgagtaagtatcttaatcctgggtt     96950
cgaatttgattacactgttgtctgagagatggttcgttatggttttcattctcttgcatttgcgaggagt     97020
gtttttacttccaatttgtgtagtccactttagaataagtgtgatgtggtgctgagaagaatgtatattctg     97090
ttgattggggtgaagagttacataggtgtctcttaggtctgcttggtgccggagctgagttcaagtcctga     97160
atatatttgttaattttttgtctcattgatctgtctaatattgacagtgttgtggtaaaatctcccacta     97230
ttattgtgttggagtatacttaaacacaatattattgtgtttgtaggtctctaagaacttgtttatgaa     97300
tctgggtgctcctgtattgggtgcatatatatttatgatagttagctcttcttgttgcattgatccattt     97370
accattattgatgcccttctttgtctcttttgatctctgttgtcttaaagtctgttttatcagaggcta     97440
ggattactaccccctgcttttctttgctttccgtttgcttggtaaatattccttcattctgttattctgag     97510
cctatgttttactttgcctgtcagattggtctcctaaatacaatacaccaaagggtcttgacccattatt     97580
caatttgccagtctgtgtcttttaattgggcatttagcccatttacatgtaattttaatcttgttatgt     97650
gtgaatttgatcctgtcattatgatgatagctgattatcttgcatattagttgatgctgtttcttttatag     97720
tgtcattagtctttacattttgggagtttttgcagtggtattttggtagttttttgcagtagctgatatct     97790
ttttttttttcttttttttttttttgcccatatttagtacatccttcaggagctcttaaaggcagtcctg     97860
gtggtcagaaaatccctcaacatttgctttctgtaaaggattttatttctccctcaattatgaaactta     97930
gtttgtctggatgtgaaattctgtttgtttgtttgtttatttatttatttatttatttatttatttattt     98000
attttaagaatggtgaatattggcctgcactcttcttctggcttgtagggtttctgcagtgatatctgctg     98070
ttagtttgataggctctcttttgtaggtagcctgctctttctctcgggatgctgttaacattttttcctt     98140
tgtttcaaccttggtgaatctgactattatttgtcttggagttgctcttctcaaggagtatctttgtggt     98210
gttttctttatttcctgaatttcaatgttggacttcttgctaggctggacaagttctcctggataatatc     98280
ctgaagtgtgttttctaactggttccattctcctactcactttcaagtacaccagtcaaacataggtttg     98350
atgtttttcacatagtcccgtatttcttggaggcttttcattcattttttctgtaatct     98420
tgtcttcacattttattttattaagttgatcatcaatctctgatatactttctttcccttgatcgattca     98490
gctattggtacttgtgtatgcctcaggaagttctcgtgctttgttttttcagctatatcatgtcatttata     98560
ttcttctctaaactggttattctagctagaagttcttgtaacctttatgaagattcttagcttccttac     98630
atggggttagaacatgctcccttagctcagaggagtttgttatttcacaccattctgaagcctacttcagt     98700
cagtttgtcaaactcattctctgttcggttttgttctcttgctggtgaggagtgatgatccttttggaaga     98770
gaagagggattctggttttttggaattttcagaattttttgaactgttttattttttcatcttcatgaattta     98840
tctaactttgatctttgatgttggtgaccctcagatgggattttttgcatgggtgtctttttttgttgatgt     98910
tgatgttattgctttctgttcgtttgttttctttctaacagtcaggccgctctgctgcaggtcagctgga     98980
gtttattgaaggtccactccagacccgtgttttcctggctatcaccagcagaagctgcagaacagcaaaga     99050
ttgctgtcttctcctcctctggaagcttcttcccagaggggtagccacctgatgtcaaccagagctctc     99120
ctatatgaggtgtccattgaacccagctgggaggtgtctctcagtcaggaagcacctgggttagggaccc     99190
acttgagcaggcagtctgtcccttagtagagcacaagttctgtgctgggagatcttctgctctctttcaa     99260
gccataggtaggcacatttaagtttgctgaagctgcacccatagccatcccttactccaggtgctgtgtc     99330
ccagggagatgggaatttatctataaagccccctaactggtgctgctgcctttctttcagagatgccctgc     99400
ccagagaagaggagtatagagagccagtctggctacagcagctttgctgagctgtggtgggtccaccccg     99470
gtttgaacttctcggaggcttatttacactatgagggaatactgcctactgaagcctcagtgatgccag     99540
acaccctccctgcaccacattcaagtgtcccaggtcaacttcagactgctgtgctagcagtgagaattt     99610
caagccattggatcttagcttactgggctccgagagggtgagatcagctgagcaagacaacttggctccc     99680
tgacctcagccccctttttaggggagagaacagttctgtctcacgtcggttccaggcagaactggggcat     99750
ggaagaaacaaaaacaaaaacaaaaacaaaaaaaactcctgctgctagctcagtgtctgcccaaatggct     99820
gcccagtttgtttgtttgtttgtttgtttatttatttattttttactttaagttctagggtacatgtg     99890
cacaacatgcaggtttgatacatgggtatatatgtgccacattggcttgctgcacccatcaattcatcct     99960
ttacattaggtatttctcctaatgctatccctcccaagcccctcagtgcctgacaggcctccatgtgtg    100030
acgttccccaccctgtgcccaaatgatctcattgttcagtttccacctatgaatgagaacatgtggtgtt    100100
tggtgtctctgttcttgtgacagttactgaggatgatggtttccagctgctcatctacgtccctgcaaagga    100170
catgatctcatccttttttatggctgcatagtattccatggtgtataagtcccacattttcttaatccgt    100240
ctatcattgatggacatttgggttggttccaagtctttgctattgtgaattctgctgcaataaacatatg    100310
```

FIGURE 11A-20

```
tgttcatgtgtctttataggagcatgatttataatcctttgggtatatacctagtaatgggattgctggg      100380
tcaaatggtaaatctagttcttgatctttgaggaatcatcacactgtcttccacaatggttgaaataatt      100450
tacgctcccaccaacagtgtaaaatgttactattactccatcctctccagcatctgttgttcactgac       100520
gttttaatgactgccattctaactggtgtgaatggtatctcattgtggttttgatttgtgttttctctaat    100590
gaccagtgaagatgagcatttttttcatgtgcctgttgctatatagatgtattcttttgagaagtgtctgt    100660
tcatatcctttgcccacttttttgttggggtgtgtttgcttttttcttgtaaatttgactttgagttgtttgt  100730
agattctggatattaaccctttgtcagatgggtagattgcaacaattttctcccattctgtaggttgcct     100800
gttctctgtggtggtagtttcttttgccatgcagaagctctttagtttaattagatcccatttgtctatt     100870
ttgggttttgttgccattgcttttggtattttagtcgtgaagtccttgcccatgccttttgtcctcaatgg    100940
cattgtctaggattcttctaggattttttatggttttaggttaacatttaagtcttttaatccattttgaat   101010
taattttgtgtaaggtgtaaggaagggatccagtttcagctttctacatatggctagccagttttccta      101080
ccactgtttgttaaatagggaatcttttcccatttcttgttttgtcaggtttgtcaaacattagatgg       101150
ttgtagatgtgtgtgttatttctgaggcctctgttctgttccattggtctatatatctgttttgtaccag     101220
taccatgccattttggttactgtaggattgtagtatagtttgaagtcaggtagtgtgatgcctccaccttt    101290
cattcttttttgcttaggattgtcttggcaatgcaggctctttttttggttttcatatgtactttaaagcagt  101360
ttttttgtttccaattctgtgaagaaagtcattggcagcttgatggggatggcattgaatctataaatta     101430
ctttcggcaatatggccatttcatgatatttattcttcctatccatgagcatggaatattcttccatttt     101500
gtctttgtcctcttttatttcattgagcagtggtttgtagttctccttgaacaggtccttcacatccctt     101570
ttaagttgtattcctaggtattttattctttttgtggcaatgtgaatgggagttcacgcatgatttggc      101640
tctctgtttgtctgtgaatggtgtatgtaattgatttgtatcctgagactttgctgaaattgcttatca      101710
gcttaaggagacttggctttgagataatgggtttctaaatatatgatcatgtcatctccaaacaggta       101780
caatttgacttcctcatttcctaattgaatatcctttatttctctctcttgcctgattgccctggccaga     101850
acttccaacactatattgaataggagtggtgagagagggcatccttgtttgtgctggttttcaaaggaat     101920
gcttccagtttttgcccattcagtatgatatgattgtgggtttgtaaaaaaatagctcttattatcttg      101990
agatatgtttcatcaatacctcgttattattttgagatatgtttcatcaatatctagcttattgagaatt     102060
tttagcttgaaggctgttgaattttgtcaaaggcctttatgcatctattgagataatcatgtgctttg       102130
acatcggttctgtttatgtgatggatgacgttcaatgtatatgttgaaccagccttacatcccagggatg     102200
aagccaactagattgtggtggataagcttttttgatgtgctgctggattcagtttgccagtattttactga    102270
ggatattcacattaaagttcatcagggatattggtctaaaattcttttttgttgttgtgcctctgcca       102340
ggctttgctatcaggaagttcttggcctcataaaataagataggagaattccctctttttctattgatt      102410
ggaatagtttcagaaggaattgtaccagcttctctttgtacctctggtagaattcagctgtgaatctgtc     102480
tggtcctggactttttttggttggtaggctattaattgttgcctcaatttcagagcctgttattggtcta     102550
ttcagattccatttcttcctggtttagtcttgggagggtgtatgtgtccaggaatttatctatttcttct     102620
agattctaacttatttgtgtggaggtgtttacggtagtttgtatttctgtgggat                   102690
cagtggtgacgtccttttatcttttttattgcatctatttgattcttctctcttttttctttattag        102760
tcttgctatcagtctatcaatttgttgatcttttcaaaaaccagttcctggattcattcattttttga       102830
aggattttttgtgtctttatctctttcaattctgcttggatcttagttatttcttgcctctgctagctt      102900
ttgaatttgttcttgcttctctagttcttttaattctgatgttagggtgtcgattttagatctttcctgc     102970
tttccccttgtgggcatttagtgctataaatttccctctacacaccattttaaatgtttcccacagattct    103040
ggtacattgtgtcttgttctcactagtttcaaataacatccttatttctgccttcatttcattatttac      103110
ccagtagtcattcaggagcaagttgttcaattcccaaatagttgtgcagtttcaagtgagtttcttaatc     103180
ctgagttctaatttgattgcaatgtggtatgagaaacagtttattgtgatttctgttgttctgcatttgc     103250
tgaggagtgctgtacttccaattatgtggtgaattttagaataagtatgatgtggtgctgagaagaatag     103320
acatttgttgatttggagtgtagagttctgtagatgtctattaggtctggtttttgcagagctgagttc      103390
ggttcctggatatcctgttaacctcctgtttcattgatctgtctaatattgacagtggggtgttaaagt     103460
ctcccattaacattgtgtgggagtctaagtctcttgtaggtctctaaggacttgctttacgaatctggg     103530
tgctcttgtattgggtgtatatatatttacgatagttagctcttcttgttgaattgatcccttaccatt     103600
atataatggccttctttgtctcttttgatctttgttggtttcaagtctgtttatcatagactaggattg     103670
caaccctgcttttttcttcttcttttacgttttttttttttttttttgcttctcatttgcttg           103740
gtagatcttcctccatctttttattttgagtctatttgagtctttgcacgtgagatgggtctcctggatc     103810
cactccagacgctgtgtgcctgagtatcactaggagaggctgcagaacagcaaataattctgcctgattc     103880
ttcctctggaagctttgtttcagaggggcacaagccagatgccagttggagctcttctgtataaagtgtc    103950
tgtcgacccatcctggaggtgtctcccagtcaggaggcaaggggtcagggacccacttgagaaggcag      104020
tctcttcttagcatagctcdaatgctgtgcctggagatccactgctctgtccagagcagttttaattctg    104090
ctgaagctatgcccaaagctgtccctttccctaggtgctctgtttcagagagatggatgttttttttctat   104160
aagtccctgactggtgctgctgcctttcttttcagagttgcctgccagtgaggaacaatctagagaggca    104230
gtctggccacagatgctttgctgcactctggtgggttctgatgaaatttcgggctgcttttttttttaatct  104300
gtgaggggaaaacctcctactggagcctcagtaatggcagacaaccctcccctaccaagcttgagtgtc     104370
tcaggtggacttcagagtagtgtgctgccagggagaatttcaagacattggatcttagcttgctgggctc    104440
catgagggtggaatctgctgaacaagaccacttggcttcctggcttcagccccattccaggggaatgaa     104510
aggttctgtctcactggattatgaaaaaaaaaaaaaaaactcctgcagctagctcagtgttggcccaaa     104580
tgatcgcccagtttcgtgcttgaaaacaagggccttggtggtataggcaccttagggaatctcccggtct    104650
acaggttgtaaaaactgtgggaaaacatagtatctgggctatgtcacagtccctcatggtttccatttg     104720
ctaggggaggaaggtacctgtcgccgtgcacttcccaggtggtcagtgccccatcctacttctgctcac     104790
cctccatgggacacatccactctctaaccagttccaatgagatgactgagtacctcagttggaaatgca    104860
gaaatcacctgccttctgatttgtctcactagaagctgcagaatagagctgttcatatgtggccatcctg    104930
ccagatcctccctaatttatatgttagtatatttttcacacacactcacacacatacacacatacatggca  105000
gcactaaattatattctctaaatgtacctacagatacttaatcatttgcacagccactatcattttatgc    105070
ttgatggcttagacaagtaactctccacttgtgggtggttttggccaccagggtgtcattcagcactgtctg  105140
gagacattttccacagttaaaactgggtaggagggtgccaccatcatctagtgagtttgaaactgggaatgc 105210
tgcaaaataccatacagtttagaggcggcatctctacacaaagaatcatatggttcacaaatcattatc     105280
attgtgctgagatgcggcaatgctgagcttcagactatagcaatttttttgcaaatttgctaaatttcaaa   105350
aaatgaaggaataaaaaaagatagctctcaacctgtgggtattgtgaatgcctaacttagacttaggaag    105420
```

FIGURE 11A-21

```
cgtacaggtgcccttgggcttgtcttctttgtctgctgctagtttataattgttcactgcccatcaggac      105490
cttgtgggttatagatttagatagaggaaggatttgatcatacaggtgggtcagtcataaccaatatgtg      105560
agtcacagtctcactcacattgagtttgagaatttaaggcatgggctggaattcctcatggaactgacat      105630
tataaacctgggaagaaatctacccactgaattccacttgagctgtctgtttcagcaactgttcaatact      105700
ttgaggttacatactatctcatttaatcccaacctgggatagtgtgtaataccaaattctttacagctac      105770
atgggattaaattaggtagtatgtgaaattccaaatagtaaattggtaaagtgatgcctaatgaatttga      105840
atgagctgctgccagcctactagtactaacagtgagctaatagcaccttgtgtccctgtacccagaagt       105910
ctttcttgcaggactgtagcgaacatgtcagcatgttgtctacgttgactggacatcttctgttctcttc      105980
agcctttgcctgtgtatgctcctgtcctgctctgcacaatttaatgaagcaggtgggacacactagttta      106050
cccttttagtagtctgcatagattgacttgcttccctcagttcacagagatagcttcccaggatacagat      106120
ttatctgaattacaagttgatggcttcattgttcacaatagcaaagacatggaatcaacctaaatgccca      106190
tcagcggcagactggataaagaaaatgtggttcatatgtaccatggaatagtatgtagtcataataaaag      106260
aatgagattatgtcctttgaaggaatatggatggaactcgaggctattatccttagcaaattaatgcaga      106330
aacagtaaaccacatacttcatattctctcttataagttggagctagaaatgagaacttacgaacacaaa      106400
gaaggaaacaatagaaaaaggagcatattggagggtgggcagtggtaggaggtagaagattaggaaaaat      106470
atttattgggaatgaggccttgtatctgggtgatgaaataatcagtacaactaatgcctgtgacataagt      106540
ttacctgtatggcaaacttgcacacctaccctgaagccaaaataaaagttataaaaaaggtgatggtct       106610
cacctattctcttggggaaggctccaaaagtaacagctacctctagttaaaaatcttctggttaaaaaaa      106680
gaagcaaccaaacacgacatcactctttgttttcttgtctgtctcttaattattcagaaatgggattgc       106750
tgcatggcagacatccgaatgttgtctacagtacaattcagagttagtagcaaacacctaaatcagccat      106820
ttgatgagatgctatttgtcactttcaaagttacaatccagattttcagtgcattttcatccaactctgt      106890
tgaacttttcccaggatgtcatgtactatggaattcccccagtaggtattattgttctgtgatagatc       106960
cagttccaatatgttttattaaaaagaaaaagccatgtgatgtatttgttcaattgattacttaaatga      107030
aatggataactattttctgatgcaaatgctctgagtaacccacaaattcctcagaaacacatttgcatac      107100
tttgagatgaagaacactctaaatgcaccctccttgtgacacctagtgaaacgttttctgtccctagagg      107170
atcatttgacatactgtccattgctgcacaacattcttttattgtcacaggagcagcgatttccctaggg      107240
atagtcatattatccttgtagggaccaattgaggtggtgaccctttaaaagttgactccagtcttaatgg      107310
gaaagtaactcaaatgtagccttagattttttaaatgggatacaggtgaagaggatacctctcaggcat       107380
gcagcagcttactgcaaagtcaggataattgcatcaacacttttagttatgaaagaagtcttcaagagac      107450
cagcactgaagcatgtacttgaaatgcaccatcttgtacagttttttttttttttacaagaaactgaagt      107520
tcagaacagtgaagtatgtagcctaaatatatatgtgcacttgagtagaacaaggaaaattcgtgtccaa      107590
agtctacactctttcatttgatgattttccccttgtggcctgataaatatccacatcacaatgacagga      107660
tggcctggatgcatgcttctatttgctcctactggaaaacttttagatctgcatgcatatcccctagg       107730
aaagagtgaaaattgccttaaacatttgagaaaaagttcttttgataacccgtctggtaaacaatagtga      107800
aattggtaggtgtcattattacacttgcataacctgtacaattcttgaacgtcggtttgttcattcaac       107870
atagatgtgatgagtgttttctaaatgtcaggcattgtttctggtgataggatatacagccaggattaag      107940
aaaagtgatggacactaggcatggtgactgacgcgtgttatcccaacactttgaaagtttgattgaggag      108010
gatctctttaggccagcctggataacatagagacacctatgtctacaaaaattccaatgaattgcccgga      108080
catactggtgcatgcttgtagtcccagctactcggaggctgaggtgggaggttggctttagcccaggag      108150
ttggaggctgcagtgagctgtgatagcaccactgccctgcagcttgcaatatggcaagacacgatctg      108220
taaaaaaaaataataataataaagacaagttatgttttttgctattgtcgactatgtggagatggcactat      108290
acacattcatatacaaatgaataggaatttcatagagagatgttgtggatttcatggaagagccagccag      108360
tgttctaggtgatcattgtgtggcttcattattcttgtctgctttctccctcctttaggttgcattggag      108430
ttttcgaaagacttatctttctgcaggctcgcctctgagctttgtctccttggagccacctcacttagac      108500
agcttcggatgtggatgcagattttgaaccATGTTGCGTCCCAGGGACTGCTATGGCTCCCTTTGTTGTT      108570
CACCTCTGTCGTGTCATGTTAAACTCCAATGTTCTTCTGGATAACTGCTCTTGCCATCAAGTTCACC       108640
CTCATTGACAGCCAAGCACAGTATCCAGTTGTCAACACAAATTATGGTAAAATCCAGGGCCTAAGAACAC      108710
CATTACCCAGTGAGATCTTGGGTCCAGTGGAGCAGTACTTAGGGGTCCCCTATGCCTCACCCCCAACTGG      108780
AGAGAGGCCGGTTTCAGCCACCAGAATCCCCATCCTCCTGGACTGGCATCCGAAATGCTACTCAGTTTTCT      108850
GCTGTGTGCCCCCAGCACCTGGATGAAAGATTCTTATTGCATGACATGCTGCCCATCTGGTTTCAATGG      108920
GTTTGGATACTTTGATGACCTATGTTCAAGATCAAAATGAAGACTGCCCTTTACTTAAACATCTATGTGCC      108990
CATGAAGATGgtgagtacctcactggaacagaaaacaatacttcttgtgcagtgtgtggagagatttac       109060
caggagggttttataatgtctcttgcatgatctttctataacctgtttattttattttaatttattttt       109130
catattccaaatgcaattcttgcagcagcttaccacatgttccacttgtatatattgggacatctactgg      109200
atggacaaaactataaataatgactttatttcatatattacctaattaatgttttataatttatttgc       109270
agatgaaaattaacatgagcatatagtgttgcatgttatacctgaatcatctgtaaaggaatgaatccat      109340
agaaaaaataatagaattaagtacactaccatgctccagtttacaaactgaaagatagagaaaatggttc      109410
tttctgccataatgacttgagatattagcacctttttgagtttgaaagaaaaactttattttttttaa      109480
tatacaagcatgaggtagttcatacaatgataggatttcattgtttagaatccatttcttaatgtaaat       109550
ttggactttgttttcttccaagatccactacgatcaaatgacaaaatatagtcagatgattctagctaca      109620
ttagacgtgatgtgttatattttaaaaatttcctctttttctataaaacaccaatgaaagtctgtaa       109690
acacaaaaacatttaatatattaacctaatgttagtaaaacatgaatagttttatgtctgtatagattc      109760
aaattcagatttcctcgaagaataacoaaagttatgccacagtggtatcatatttcccggttagcatttc      109830
catatgccatttttagatgaggagaaaggacaacagagaacaaaatatacctggaaagaaaggaaataat       109900
ttgtgagaataataagacatatctaatgtagaaactagagcttgtcttttgcataaagctcgtgtggaga      109970
atgtgataaatttcttttatggagaatttttttcttctccattgttctttacactttaatacctggaaaat      110040
atttttcagtaaaatttggctgaaagtattaaataaacaattacattaattcattgatctccaaaattat      110110
attgcatctgtcagattactctctctccaggtaattgctagttagtctaagtagagcgtcattaaaaact      110180
agaccagggttgtgtgccattgagattacaaattgccattgagattacaaggaacagttcagagtaaaaa      110250
agtaaaggacccttgcttcatcatattagtggttttctagaatattgcccttgtcattagggtgacagatct      110320
cccaatcatctcataaaatccaggtctgaatgtgactgaaggagtcaaactgacgtttggatgctgtact      110390
tccatgggtgttctgtgctgtctctgtgcctaatagtccccttttgtgcatgtgtgtgatgagaaagagc      110460
tgtcaaaatctattagggttctcatttgagcagccacctggggttgagatcttctcataaaggaactatt      110530
```

FIGURE 11A-22

```
caaaccaaaagtaaaaagaatggaatacaaaaattcagagaaaaaccccaaacaggacaaagtattacaa      110600
ttgcttttataatacattggatatgctagagtctaggacctggtgattttatagagctagccttggcaac      110670
aatgaatgcacttcaaataggatgcctcctcatataggatgttggatggaatgagaccacccatgaaaaa      110740
aatcaatagcttccatgacagcagagccctgtaggtacaattgtgtggatggagaccacaaacagggtgg      110810
acgtttcattgtgattcagtattgaattgtaatttggggagtataactctgtgaaaaatgctattcagtg      110880
aaaaagtaatccaaatttcataataaaacccagttccacttctattctttagtcttttttgaagcaatatgc    110950
gcatacgatcttgaaaagggaatcagaaatttaatagtgactgaaaaggtagaataaatctccccacaat      111020
gtgtaaactttaaaattttgcttgtgagagttcaaagctacagccctgcatgtttacacaaaccacaagt      111090
cacagactatcgagttaggagggttttttgtttgtttcctcggttgttttgtatctctatcaactcgat      111160
aggcaatacaaagacttagatatttaattattgttcattcactaagtgaatgaactctgcattcataaca      111230
acctactgaaatgttggcatcacgctgattctctccaaaggccttctcttaggcagtatctgaattcata      111300
tcagtgcttttgtttagcaggatagaaatattattatctggaattcagaattctactctgaccacttaga      111370
atctctacttttttttgtttagctttgtctttctgccttgatcatatttgctaaaactttcacattcttaa    111440
tttcataaaatgtgtacatttattaaaaatgcaaaaacagactttatttcagttaagtacttattcttaa      111510
atttaagaaataaccttggatgagaagtgttggacatttctttgtagtacaatagtttcatgaaacataaa     111580
ttgtttttcggtagaaagcagtatttttttataattcccttcaaataaatcacatcttgctgaagttgagt    111650
cttttcgttcaaattgtcatcatgatctactaagcttagtcttgagtctttatacctaattacaaatttc     111720
tatatttgtaattagctatgccatacaaatttatttagatttatatattataaatttctttattgtcta      111790
gatgacaggttaattaacttaaattgcatatttaacattttgataggtgctcaagtaaggtcaaaatcaa     111860
agccagtcagaagctctagtaggacacatgggatattgctcacaaggaagagttggagaccgcatccgca     111930
tggtgtgtgtgtatgtgtgtgtttgagagtttgtgtcacatgtgtcagagagaaagagccagagg         112000
aaaagaggggtaactgagtgactattttgaagaagcagtgcagaatatggcttggtagcttgattaaac      112070
aaaactgatgaaagtcaagctgagaagttccaatctcacatactaagttcatgtcagttcatacatgaga    112140
gcatggcactacaatttgagacttctcttggtcaccaaggagactgaacacagaaagacaagctatgaa     112210
acgcttcaggtttttaatgagaaccctttggtattgaagtgaggttaaaaagtaacggaaaaataaaagac   112280
acatttttgaagtagttgctcacacaagatattgtattaaatataaagcttggaagagaaaaaagccgtaag  112350
ttgagtccagggtgtcttggggaatggacagagccaaggaaccacttccggagtgatttacacctgtgct    112420
ttctctctgtatccttggacatacatcttaaggtcttattcttgaatgatttcagggcaaaaagcccttc   112490
cattcttcataaaggtgtgtccggaattggtgggttcttggtctcactgacttcacgaatgaagctgccg    112560
accctcgcggtgagtgttacaactcttaaagatggtgtgtccagagtttgttccttcagatactcagatg    112630
tgtctggaatttcttccttctggtgggttcgtggtcttgctgacttcaggaatgaagctgcagaccttcg   112700
tggtgagtgttacagctcttagaggcagcgcgtctgagttgttggttccttccggagtagttcatccct    112770
cccggtgggttcctggtctcactggcttcagcagtgaagctgcagaccttcccagtgagtgtcacaactc    112840
ttaaaggcagcgcgtctgcagttcttcattccttcctgtgagttcgtggtctcgctgacctcgggagtga   112910
agctgcagaccttttgtgaaggtgagtgttacatctcataaagctggggacccacaaaaagtgagcagca    112980
gcaagattattgcaaacagcaaaacgaccttccaccgtgtggaaaaggacaccagcagattggcgctgt    113050
gtgctttgggcagcctgcttccattccctttatctggccccacccacattctgctgattggtccatttac    113120
agagagctgattggtccattttgacagagtggtgcatgtacaatccctgagctagacacagagtgctgat    113190
tggtgcatttacaatcctctagctaggcataaaagttctccaagtcccccaccagattagctagatataga   113260
gtgccgattgctgcacatacaatcctcagctagacgtaaaagttctccaattcccagtcagtcagcctggtgt 113330
ctcagcctgtgatcccagcacttgggaagcgaggtgggcggatcacgaggtcaggagaggagaccatcc     113400
tggccaacacattgaaacccgttctctactaaaaatacaaaaaattagccgggtatggtggcacgcgcc    113470
tgtagtcccagctactcgggaggctgaggcaggagaatggtgttaacctaggaggctgagtttgcagtaa    113540
gccgagatctcgccacagcactccagcttgggtgatagagagcaaggctcaatcttaagaaaaaaaaaa     113610
aaaaagttctgcaattccccagccagctcaggagcccagctggcttacctagttggatccgcgcgctggg   113680
gcctgccagtcccgtgcccgcgcctgcactcctcagccctttgggctgtcaattgggagtgggccctgcag   113750
agcaggggggcggtgcccgttggggaggctggggctgcgcaggagcccaccgttgggggggctagggcatg   113820
gcgggctgcagatcctgagccctgtcccacagggaggtggctgaggcctagggataattggagctccaag   113890
cgggcgggccggcagtgctgggggacccagcgcaacctccgctgctcctggcccgagtgctaagcccctt   113960
tctgccctggcctgccactccgagtgctgcccgccgagcccggagcccggccacccagaa            114030
ctcgcgctggccccgcaagcgccgcgcacgcccagttcctgcccacacctcttgacctctccttccacgc    114100
ctcaccgcaagcagagtgagcgggctcccgcctgggccagtccagagaggggctttcatagtgtggtgtg   114170
ggctgaagggctcctcaagcgcagctggaatggacgccgaggcctaggaggtgcgagggagggctgctag   114240
cacgttgtcacctctcaatgggactgaaaaccctgggaaatataaagaaaaaatataaatggaagtcatt   114310
attgccaggtgcggtggctcatacctctaatctttagtaggcgggaggtgagtgagtcacttaaggtcga   114380
gagtttctgatcagcctggcctcaggaggctgagacagcggaattgcttgaacctgagaggcagaggag    114450
gttgcagtgacccaagattacaccactgcactccagcctcgtgacatagtgagacactgtctcaaaaaa    114520
agaaaacagaaaagaaggaaagtcactatcattgtcttttcattgtaggataacagcaaatgccattgtg    114590
atttctagagaagtgaaattctgttttttgtttgtttgtttgttttgctagcaatacaatcgaaaaaggaa   114660
gctatttaaaaaagagcagataattgaatgcaaggtgtccctatcatctttttttccccaagatgaaacct   114730
gcgactttgaattctattacttaagtaaacatgccacgattagtgattgaagacctattcggtgaagctt    114800
ggagctttatgatgaaatataaacagacgtgacatggacattgacctgtagaaatttggacagttagtaa   114870
acgtagaggtagatgataagccacagcatccagtgaaggaacaaagaaagttctgtgacagctcaggga    114940
caagttatgttttgaggaaatcttgatggaatctataaatggttgagctgtgtcctgaagaatatttggg   115010
ctatagaagggattcatctattaagcatctgttgactggaactttgaacacacaaatctatgttaagca    115080
gcttggcgccaatcgttgctgttgttactacttgggtgttaagtgtggcatggtaacagaagctctgctt   115150
taccacgtgctctttctgtcagtgccatataataaaagttattttattttttattcttattttttttttatt  115220
tagagacagggtcttgctctgtcacccaggctgaagtgcagtggtgcaatcgtagctcactgcagcctcg   115290
actttctgggttcaaagaattcttcatctcagatttctgagtagctgggactacaggtgcactccacca    115360
cacctggctaatatttttgatttttttatttttgtataaataaaaattttatacaaattgttgctctggctgg  115430
tcttgggctcaagtgctctcccacctcggcctgccaaaatgctggaactactggctaagccattggact    115500
gggaccataaatgttttatgttatccatagctgctcaccatggcacttgtgggtagacaagctacct      115570
aagatgaaagggtggcagatgaacgacagggaaagaagctagaaagtcaactggctttgctagtgttttt   115640
```

FIGURE 11A-23

```
acaaaaaaatgcattcgcttcccttgtagacagcactggatgtaattcaagatataatttatagcacggt    115710
tttcatccttgaatatctcccatcttttcaggaagtcgtacaaacttttctggcattctgcgttagtgaa    115780
agggtgttggactatgtccagctggtagaaaataaacctagcctcaatctggcattgagggaaaaattgaa   115850
atttattagaagggtggtgagatatccaaatttactgcaaaagtcgagaaatcagattgggagaagggca    115920
gatatgcagctagactttagaggcacctggaagaaatgagttaaaggacatcaccaatcttatgtctggt    115990
tctttgcttctttctggaaatagacttgctttacgtggtgagtgagagggttctctgcagttttcactac    116060
atgcatttgttttttctcagtaccaccagtgaaggacaaagttccataattccatactaaaaatccctgg    116130
gcagagttttaattggctcagttgacgcaatagtaagaagtgataaaactgggctgctcctgggtataac    116200
agttggcaggggagaaggacagttcttaccacaaggtgtctggaatgagcaggcactgcttcacttcac    116270
tgtccaaaatattttgaggagcagttatatgccaggcaagctttagaggctgagatttcaagtttacaa    116340
gcatttctaattttgagtgataggtacttgtaggcagaagaatcatggtccttgagagatgtgcatggcc   116410
ttcctcctcccttcacctgtcattgctggaacctcggaataggttgctaggcatggcacctgacttcttc    116480
aatactctgccttaagtattgacttcaaatggcaaggggaattaaggttgtagacggaattatgtttgc    116550
taaccagcagaccttccaatagagagaattatcctcagttacataactgagcacggtatattaacagaag   116620
ccctccaatgtggatgcagaaggctcaagaggagatcagagttggagtaaagcagcatgtaaaagagata   116690
cctggacattgctggctttgagtatgagagagccaggagaaaggaatgtaggcagcagcgtttggaagct   116760
agagaggcagggaaactgattcttccttagcgcttccagaaaggagcccaacagccctgctgacacctca   116830
attctatccccatggaagaaactgtctcttggaagaaactttacctctggaagaaaccctagccccatag   116900
aagaaactctgaagaaactgtaaaagaataaatgtttgttgttccaagcttactaaatttgtgggagattt   116970
gtgatagtggtaatagaaaactaaggaagagtttttatcaccctttaatatgatttgaaattcataatgaa   117040
gtattactctgaaaacgaagttcagagtcactgaagtcattaggtttgagccttctgaccccaagtccg    117110
ttctgggattctacttccaataatttctagttgaaaacactcttgggcacttggagctttctgtcttcct    117180
caagaatgtcgaggagacaatacagatgactcttttagggcagatatttttcagattttttaaaaaatttc   117250
tcttctaaactttgagtgagagttaccctgtccctgagcgggatcttgcactgttacccaggctctagtg    117320
cagtggcacagaagctcatcctcaaattcctgggcacaagtgattctaccacctcagcctcatga         117390
gtgtctgggactacaggctgatactgtattaagcttcagagaagaagcatgtccaggttcctgcaaatta    117460
gaaaatggtagcagatatatatattttttttttcaagaaggagttttgctcttattgcccaggttgggggta  117530
cagtggtgtgatctccactcacagcaacctctgcctcccaggttgaagtgattctcctgcctcagcctcc    117600
tgagttgctgggattacaggcatgtgccaccatgcccagctaattttttgtagagatgagggtttcaccatg   117670
ttagtcaggctggtctcaaactgctgacctcaagtgatccacaaagaaacaatgaaaaaaaaatcccta     117740
ttagatttacattacaattttcagccaccatgactggctagttttttaaattttttttaaagagttgtagcc   117810
ttccaggctggtctggaactcctagcctcaagtgatcctcccatctcaggctccagaattctgggattac    117880
agacataagccaccatgctcagggacattctgcaaatttgacatttttgcattaggttaatatagcccaa    117950
ggcaaattgtcctaaacagcatattccacagatacactttgacacaggaaagtaataaagggtcatt      118020
taaattttttttcagacagctatgacagatttccagagatgatggctttgaatgacttataacaaaatac    118090
ccaaatggttctttcatcatctgcctccatagagtttcacttgtgatggtggctgcacctttacatttct    118160
tattttcctacttacaaacactgctgacaaaatcttctgagctctccattccttccagctacaacttaac    118230
ctgtggtctctgctgggcaaagtgactcacctttttgaatgtacgccttgtttactcctccagccaaaact   118300
tgtttgctggagttgaatgccagtttatcccccttagcagatcattatgggcaagtgactcagcttttcat    118370
gggacacagtgcccttatgtctaaaatagaggtagctgagaggtttaaggttataatccatataaaatgc     118440
ttagtatccagcacatacaagcaccctgtaatctgatgttagtgcaatatcagtaataatagaaaacaga    118510
acttgacaatttcagcaaaattgcatgtgcatagtgggtctggtatgtgtattaatccaggcataataaa    118580
tgctgatcatctgtgacatagctgtttactgttgtagtggaggggtaagctgaagaggtaagaccaacag    118650
cccattatttctggtggtttctagtatggtttttaacaaatgggaatttcaggaaaagtaacacttttaa   118720
aagagctgactgttatcattctgctttattcctgatttttagtcttttttgagctcctgttgtcaaatggat   118790
tttgagcatatgtgaattagataaaattattccaccatgaaaggattagaataacattttggaaaatgccct    118860
taaactatcaagtggcaataacactactctttgtgtgtgatattaaagagaaattaattctcattttcttt    118930
gttgtctagacacacaaagtccaattgtatgcatgtaatcacaaaatctaggtgaaaattgaaaactatg    119000
ttaacagagtgagaccgatgtttttaaccaatcaacatcgacatcaacatcaacatacaattattaaatttac    119070
tccagttttcatctgtcagtttgatgtttgacattgtgtagacatagcttgccagtaaagataattatga    119140
aagattattaaataaagatctccctgacatggattaattgaaagtatttagtattttttttaagcacag     119210
ttaaactgggtggatttctgatagcatgtttctctcccagcacaaaaagctttcagcaatttgaatatt     119280
gagtaataatcttattgagggtttggaaattatgtgtgttttgaataatattattggtagtatttggtag     119350
tatgaattatgcctgttttgaataattaagaagtagcttttcattttcatttttttgagacattactacaca    119420
taatcttccagtacatgaattttaattcaatttacaatttagattcttgtcataattgaacaatagatt     119490
acctagaatataataaaaatcaaattttcatatagtacatatcataattttatcttagaaattgtcaga     119560
gatagaaactttaggtacatctagtccattggaatatttggccatttaaaacaattagcttttatttat     119630
ttgtggagtcttgcttcctaagatgttgtagtctaattttgtcaattaatattgctgatttgaatactg     119700
ttatttattttggatactacttagccaagctattactatttattcattttttatttttgagacagtagt    119770
cttgctctgttgcccaagttggagtgcagtggtgcagtatccacaacctctgtctcccaggttcaaga     119840
gattctcctgcctcagcctcccacgtagctgggactacaggtatctgccaccacgtccagcaaattttttg    119910
tatttttagtagagatgggtttcaccgtgttggccaggcttgttttgaacttctgacctcaggtaatcag    119980
cccaccttggcctcccagagtgctgggattacaggtatgagccaccatgccttgcctagccaagccattt    120050
aaactttaaatattagtgtcatcacttattaaaaataagactaatatgattataggtcctctgatttt       120120
ttttagaattatagtgatatgggagtaaataaatatatacgaaataattataaaatagaaagattagt      120190
gcattcttagaactttaatgtcatgttaattgaatgttaatccaatgactttatctttcatttcaagatt   120260
ccttgcctgaatgaagtagtggaagcccttgttgacaataggtcctatcttcctattccgcttttggtt     120330
ttcctaaaccaggttgtttacataatgactaagtttaacattttctctttatgtttaagcatctctttcc     120400
ttggtgcaatcacagccaaactgcagtgaaaacaaacagaaatgagaggttgtgagctccagatttcag     120470
agccacagagagtttgtgagatcaaaaaataaattttattgtgaggtcaataaataaattagacctaccta    120540
aatcacacagtcagtttaaggcaatggaaccagagggaaagactccaaaagagtgacctatctatggaat    120610
agctactggtaaaatgaagcaacaatgagacagtgtagtctccaccttattatttcaatctaatgttctg    120680
tattgaggttcagagaagcaggtccaggtttccacaaaattaaaaagtggaggattgctcctgtaatccca   120750
```

FIGURE 11A-24

```
gtactttgggagcctaggttggggcttcgcttgagcccaggagtttaggccagcctgggcaacatgacta      120820
aaccctgtccctaccagaaaaatgaaaagagttgggcatggtggcactggcctgtagtcctagctactta      120890
cagggctgaggtgggaggatcacttgaggctaggagatcaaggctgcagtgagccaagaccacagcaggg      120960
cactccagcctgggtgacacagtaagaccctgtatctaaaaaagaaataaaggaaaaatatttccctgtt      121030
agatttacataccctgatgatgactttaatggtgaaggtaagcattggtgtgtgtgtttgtttgtgtttg      121100
tgtgtgtgtgaatggtgttgaaggaagcccataggaaaagtacccataatttattcaagatcaagtatgt      121170
tacagttttcttggcaaatgccaagttataaaacacataaaccactctacaacctcttcttccctaaaac      121240
cccaaacatcttgaagtctccttcaagccagatatcctcttggtcctctgtgcaagttgtctgcacagtc      121310
ctcaggtttgtctttgggtaagtccctgttgccatcacaaagaaagaacacagcaggtattgatttgtct      121380
cagacaaaggagctcttctggtgggtttcaacaagatatgaaaattctaggttcatgaacactccctttt      121450
tcttccttaaaaataatattttagctacattctactccactctgtcttttatgacataatcattcactc      121520
aaccagggaacacccactatttgcctaacatcctatctgcctatcacatatggactttagcctccagtta      121590
gaccaatgatgctattgatctcctaatgtatactcttggatattttcatctcttttccattgc          121660
ttattatctttagagacattttaggtagctcatttaaaaattattaataaataaatcattatttgcaatt      121730
agcatagacaaggacttaggtgagtgttaagtgggtatgcagagagatctaaccccactgctgaaaaag       121800
tgagtgggaaagtcccattgatatgtgacccaactaaaccaacattctataaaaagcacaaagccttcag      121870
cgactgctttaggatttcaggggaaggaaaatggaggcaaatgtgaaagttgagttgatgtcttcatttc      121940
tttttcttttctttttcttttttcttttttgttttatttatttatttatttatttatttatttattatt      122010
tatttttttgagacagagtctcactcttgataaccaggctggagtgcaatgggatgatctcagctcactga      122080
aacctccacctcctggttcaagcgattctgctgcctcagcctcctgagtaaccgggactacaagcctct      122150
gccaccatgccctgctaattttttgtattttagtagagatgggggtttcaccatgttggcccagctggtct      122220
cgaactcctgacctcaggcaatccacccacctcagcctcccaaagtgctgggattacaggcgtgaactac      122290
cacacctggccgaaagtggatgtttctgtggcggttccttgatagaaaggttttcatccagtcttgaga      122360
tgaatatacagagtgtaaacacatacaggttgtgcagtgaggaagctgtctatgttttcctaaaactgaggt      122430
tcttgtttattgcttcttttagctgcacaaagacataacacatgcaaaattggggagaaaggagagataaa      122500
actatgacaaagctggaggcaatgtgcaatgatgttgtaatttaacatgcaaagtactcactttagtatt      122570
ttttacattgttacactgtgacattgcaggattcataagtggaatttcatccaaatttattctaatgcat      122640
attttttctacttagcagactatacaatatggttaaatcaaagaacatgaggttttgttcttaccaaat      122710
tcaaaaatacttttttatcacctgttgtttaaatcattaacacaaaagatttcagtctcccacaaatttct      122780
aatgtagtaaaatcctttcataatttttatattcaaatatattaattcagatgactagtatgaaatcaat      122850
gaaatcaagttataatttgcatgtttctaaaatgtttaaatttaaaaatggaaaagtaagccctaaaaaa      122920
ctgcaggtttctcaagaatattaaaatgttaacaaattatttaattttgagctaaaatcagataataatg      122990
ggaacagattcaccactgcagcattctacagggatgtttgcatttttatactgtgtttttgtttgttttata      123060
ggaggagattttggtatattaaatataatactagacatttacctggacataaatggtagaatcaacttag      123130
actctaatcacagaatgataacatcttccaagtagaaggagcttttgggtcatttaaccaaaactcttt      123200
caccttacactatttccatgttcatgttaaccttttggtactctaagaagagatgaactatcatttctta      123270
agttctagaagttgaatttaattatgattttacaaatctgccatctccagtagatggtaaatgctttgaa      123340
gacccagagcatttttgagataaaataatgagttatatattttattgcatgaaacaaatgaatgaacctg      123410
taatgcctggccaccacctattttttttgaacctgaacaatgaagatgtttgcggcttttttctcttcatt      123480
atgggttgagagggtaggggagggatataattaggagaaatacctaatgtaggtgaaggattcatgggtg      123550
cagcaaaccaccagggcacatatatacctatgcagcaaaactgcacgttctgcacatgtaacccagaatt      123620
aaaagtataattgaaaaaaggcattaaagaaagggaaaggttggtgatgtttacctgagcactctcacaa      123690
acagagataagcagttttgaatgttaccttcctcttctaacatatagttctgaaagtcttagaaaacat      123760
gttattttattccttccaggtagtctttttgcaagcatcctcactcagtgtcaagcatttctctcatgcat      123830
cccattatgtgttatgaatacacccagagtttatgtgaaatttttttatttttttattttttggcaaatgt      123900
attaaactcttggtttgtatattttgaactggaagccacatttttgtaatactttaaaagcaaaatattt      123970
tataatatgctttagaaattaaaagaaaataggatacctccatttcctatgacaaactctcagcatacag      124040
caaggcaaagctatttgctgctgaagctcaattttttccctgcagatgctgaatgtacaagaattaacagc      124110
caagccaggacctgtttaccttatgtttccctgaaatgccaagcccatgaggtgttacaaggagggaag      124180
acagcatacaaacatgataaatgactaataagctaattggtttatagttttgagaaagcagttggttgc       124250
ctatgttttttttttttttttttgtgtgtgtgtgtgtgtgtgtggtgaagaaatatttgtatttcatttta       124320
agtgcaactaatttctatttaaatttaagctgccatatgtatctactggctatagcattagagtgtttag      124390
ccttagcaaccttccttattactatatactttttctttttctttctaacacttttaaaatatactttaag      124460
ttatgggatccatgtacagaacataccaggtttgttacaaggccataactgccatggtgttttgctgca      124530
cccatcaacacgtcatctacattaggtatttcttctgatgctatccctcccgtagcccccatacaccaa      124600
caggcctcagtgtgggatgttcctctccctgtgtccatgtgttctcattgttcagttcctacttatgagt      124670
gagaacatgcagtgttggttttctgttcttgtgttagtttgctgagaatgatggtttccagcttcatcc      124740
atgtccctgcaaaggacatgaaattatccttttttatggctgcacagtattccatggtgtatatgtgtca      124810
cattttctttatctaatctatcattgatgaatttggattgcctattttaaatgcagtgagctataat      124880
ttgattgaatgcagaaggaatcatttccaagaaatttaaagttcgaaggttggaaaataaccgagttcatc      124950
gttagggaaagcttattctaaaaacttcggataaaatgagcttcctcttacattttattcaacttaagatc      125020
ttgtagttacttataatcatcattatcatcatcaaaaacatcatcagaatcatcaccatcatcattatct      125090
aaatttgagtagccatcagaagatattgtgagttcctgacttgagaaggattaatttctttgagattta      125160
tactgttatttaagactgtggagcatgggttagatctgtgtttaaaaacttgacagaccacattatt      125230
ggtaatagttttctcttagcatgggttttgagttgacttgtgttacagttgaattgtgcgtctcaaaaaa      125300
aagttatgttgatatcttaacatctggttcctaggaaattcaccttatttggaaatatggtttctgcaaa      125370
tgcagtcaagttcagatgagttcatactgtgttagggaagattctaaacccaatatgattagcgtccttg      125440
taagaagagacagacacaggaaaggcagagccacgcgcgggcccagccctgcaaatctctagaaggtgac      125510
gatattcttaaacacttcgaaatcattggaagaaaattcaactgggctctgcctcctgcctgggga       125580
tgtaattagctgtatagaaaacactgtgataacctactaaggagagtagcctatcaagaagctcaggtgt      125650
ttggcaatcaactcatttctccaaatgcacaagtgaagaaggcaactgtttttctcaatcctgcagcttg      125720
caaaggcaaagccagaacttgatttgaaaaaaatgctgccctgatttacatatatccaggatggatatg      125790
tctattattagggcaggttatgagggataagtcaaggaactcctggaactgatgttaaacacagttgtga      125860
```

FIGURE 11A-25

```
tcattgttgtaagaggagatgggacactgaaggaggatgttactggagttcttcaaagaacagatgaggc    125930
taccttcagtaagattcccattggatttatcccactgggacggaccagtagtttgagtcatacctcttt    126000
gctgaacgtggaaacaaagtccaacatataactgatgccacatttgccattgtgaaaggaaagacagttc   126070
cacttgatgtcttgcagatgcaaggtgaaaaggaatagcctgtgtttgcagtgactggccttcgatgggg   126140
acccttcagatgttggcatcaaagttagcaagtactggtatcttgcgcctctaaaaatcaaagcagct    126210
cacttttttcagcactctcaaagagtggcctcagactcaccaagcctatattttacacacggcacctacag 126280
agagatctcccagtgaaccagaatagaccoctgtgcaaaggccttcttttttacagaagaatattacaaag 126350
tcttacatcctactgggcacaaccggagcatgcccttttcccaagatgtgagcccagagatctggaaagat 126420
gtgcagctgtccaccattgaactatccatcacaacagaaaaatcagcttgacctgccaagcgaagaag    126490
attttatgaacatctgaattgaacgaacaccatcagcaaaggagactttataactacaggaactcgaaag  126560
gtttgaaaccgcaagctgcacatcgaaggcacagtgtctccaagccagccagtgcactttgcttgttgcc  126630
aatggagctgggggctcttttggcatagacagtgaagagtgtgatgtgaagcctgtggaggtgaaactgc  126700
tccccaggaagctgcagcttttctatgatcccaggaagagagaatagatgctggcaagccccacccagaa  126770
agcaggcagaagacaagtgctctgagaccatactttaggccaccaggaccaaaaggaacagatgcc      126840
tcaaccatcccaacagtgttgtcagagtgtcccaagggcttttttcatggcaagtagcctctggccttctc 126910
cagcagtgcttcccaaagtatactctgtcacctgttttgcaatcaggttttgttagggcatattttattt  126980
tggtgtgatggttgaccctcctaaacacggactttcctcagactggttcaagatgaaaaggactttctt   127050
ctgtttctcccaaagtgcaaccacagtgcagagcccacagtgggcttaggctgcctgggcctttccatt   127120
ctggttctgtcttttgaccatgctcagaattctggggaaaatgccttccttccctggtgacctttcctg   127190
tttctaggcttctccacaagtgctgctatttttgtgagctctggctcctgtttagcttttatatcagttct 127260
atcctcagtccagaaatgtatatgaggttgtgtcccccttcagccatggcaacaatattgtaaaatgcta  127330
gttttttattttttttaggtagtgctttctaaatggtttgcatgagagctacctggggtacatgttgaaaat 127400
tgatttatttggagtccacaccaaatctaataactcattttggggataaggcccaggaatctgcatttttt 127470
taaaagttggccaccctttccaggtgattctgtaagttgtccctcaatgcacttggagaaatagtgtttt  127540
aaagcagtggtccacaaagtattctgcttgtgtgccccagaagtattttgaaaaatcatgtattcccctt  127610
acccatctaagttgatatctaagattgttcatgggacattaaatagttgacataatttgtatttgctgct  127680
ttcacgtaaatattggtatttttaaaataaaaactgttatatcaaaaaaaaagaagaagatatgcaacgac 127750
aaagacaaaaacaaggagaacaccatgtgaggatggaagtaaagattgaagtgattcatccctaaactag  127820
ggagcactgttgaaaactatgaggaactaagaacaagcatgaagcatgaagcacaatccaagacagaa    127890
gcatgaaatggattttccttcagagcctctgaaaggaagcatcttaattttggactctgctccagaacag  127960
tgagagactataagttttttgttgtttcaagtcagcaagtttgtggtaattagttacaaagtcccagaaat 128030
gaatgcagtctggattaggtatattctgtatatataagctgcctaagaatgccagaagccagaagaggtg  128100
gtgtctgcatttctggttcctaaaatcctctctcagtacccactgttctgtccgtggccaaagctctcctg 128170
acacatttttagccttaggctatgtcctatttccccctgtccactaggggaagtagttcttgaattcccgc 128240
ctcccaaggctggcattttaccaagtgaaagacactgccttttgtgtgcaactccctccccttgagtgtagg 128310
gaggaaataggatttccttctgtctcatggaatatgatagaggtaatgaacaccacttccatgattacg   128380
ttatataagcatataaatgtgtcttcctagcataccctttctgttgcattcttggtttccatgctttgat  128450
gaaatgagcaaccatgttgaacaggtgcaaatgtcaagaagctgacagctgcctctgaacaacagcctgc  128520
aaggaacagaggcattcagtccagcagtccacaggacattgaaactctgcaaacaagctgtatgtttgga  128590
agtgaatcttcctatgtcagctttaaaatgagaccocagctcaggccaacaccttcatcagtaagagact  128660
tcaaagcagtgggtccagctgagctagtgcctagattcccaataagcaaaaactgtgataaagtaaatac  128730
attaatttgaagctgtttaagcctactggccccacccagtctcttcccaaccctggagagtacatttcaa  128800
tctaggtgtctcttttccactggatatagacattggttggcatgcagctaaaatcaggccaatatgcatag 128870
ttgcatattaatttaaattttgtggttatttgttagaaagtagtcaataactgtggcataataagcaaaag 128940
tggatttcagctgagtacagtagcttgcacctgtaatctcagctacttgggaggctcaggtgggagaatt  129010
gcttgaggccaggaggttgaggctgcagtgagctatggtagcgccaatgcaatcatagttcactgaagct  129080
atgagcctgggagacaaagcaagaccttctatttaaaaaaatacatggatttcaaaagttggacagattg  129150
taacccaaattctacatagataccatgtctccaatggagggatatatattttttaggttttgcaatcttag 129220
gaatagttggcaagtgaaagaaattctggttaaattgacttaagggaaaagaagagattttcagcctccc  129290
tttactagcagtacatttaatttagaaaatagtgtcctcaggtttaatcattgccgttaggaacctggca  129360
ctttggtgccatgtttcttcttttggctttctcagagacgctgtctttgtgtggtggtaggcagtcaaca  129430
gcatttccttgtatgccattgtttcctcagaaagcaaattggcccagtaactgtgcatattggcctaatt  129500
ttagttgcatgccaaccaatgtctatatccaatggaaagagacacttagattgaaatggcctctccaggg  129570
ttgggaagagaccgggtgggtccagtaggcttaagctgatgcaagtaagattgctccccagagggaaat   129640
tgaatgctaggtaagcaaaactcattgatgtccattgtcattgctcaaactgcaaatagtcccaaggaag  129710
aaagaatggcatgggtgcttcatggacgagactaacttgggggaaaaatcttacctaggatgtttcttt   129780
ttttttagctgaaaagaagcacttggacattcagaaatgagaaaacttgtttattagctgctgttgttggt 129850
ttgtaaacagctgtagcttttagtgacatatagaaataacatgacaggaacagatgaggatatttctatt  129920
atgatgttatacaggcagttctatgttgggagtcatcctcctggggcaatcctggatctggaagctgtca  129990
gctggtggcaaattagagatagcttgagatttaatgccagatgggaaacatgacctcaaatgaattaggg  130060
tctttagtcctgggtgtaatatgctgtgcctgacatctcttttaagagttctaactgaaagtttaggttt  130130
actgtagaataagccaatttggggagctcatcttgtgaacatgaaaatgaatttggacaaatttcaacct  130200
aagcctttagcacagttaaagtttggaaagagtttcattgtagagcgttaggcaattggctgacaaaaga  130270
gcatccagttttttctcaaggaattctgcaaaaagcaaagagggcctactcagcatcctcagcctcctttttca 130340
gcttagtggacttgtttgtgagattgtgctgtgaatgggttctcaggctggtgataaaacctcatcttca  130410
attcttgtgcagctttgtataagtccaaagaggcaccactatatccttactacatgaagtgtcattgggt  130480
tgtttgttaatgtttgtttccatatgggcccccaggcattagcaaacatgtagtttattcatttatttatt 130550
cactcagtgaatatttattgaacctaatctaattttcaggccattttgctaaatgacatcctatcactt   130620
tattgaaagccatagagggggaaattgcacaactaactggaaccatttagtataatcattgcaattatgca 130690
gcaagctggggaggtatgagaacatctgggaggagtatgtatccgagactgagagagtgaaaatgcagta  130760
aggagaaatttgacgaatgagtcactgaccaaattgctgggaggaaggtcatttcaggcaaagagaagag  130830
tgtgttcaaagctgaagtctagagcctgacattaatatcgattctcttagctaagttgtttatgaaactg  130900
aagtttgtgaatttgaagcctgaaatgtctgaagtgtagtcaatgtatggtcagttaatctcagagcaca  130970
```

FIGURE 11A-26

```
tccttcagtcatcagtggaactagagataatatattgacatatgtgctctaatgaaagctgagaagctca      131040
accgggacaagtgtttatctaaaagggggtctgacctccttttagaaatgggaagcaagtgtggacagca      131110
taacccatagaccaaatcattcacactttctgtcggttttaccaaagggtttaatggaacacaaataca      131180
cccatttatttacgtagtgtctgtgactgttttcacactacaaaggcaaagttgagttgttgcaagagac    131250
catgtggcctgcaaagtctacaatacatacaatcttaccctttattttaaaaagtgttctgacacctgat    131320
gtaaaggactggcttcatgaagtcaagtggagatcttctaagttaccatatagacatgaaaggaagagta    131390
cagaagttccatgatgtacagcagtggtttacaaattggctatgaatgttttccaaatgcagattcctgg    131460
gctctatccaggcttccagtgaatcacaaaatctgaggataggggcccaacaatttgcattgtagtggcct    131530
tgtaggtgatattgatggcaaaaatttgaaaattggacctgaattttttttttttttttttttttttttt    131600
gtgacggagtctcactctgttgtccaggctggaggacagtggcgcaaatttggctcagtgcaagctctgc    131670
ctccatgttcacaccattctcctgcttcagcatcctgagtagctgggaactacaggcacccaccacccc    131740
cggctaatttttatatttttttagtagagacggggtttctccatgttagccaggatggtctcgatctcc    131810
tgacctcatgatccacccacctcggcctcccaaagtgttggtattacaggtgtgagccaccgcacctggc    131880
ctgaaatatttttaatccaaatataaacagatactcctttctgccattaataaacaattagggaaaaaa    131950
aaagataaaagcctgttttttaagaccattgtccatatggcttacacaagataacttcctgaagtgacctc    132020
taagacgaaatagttgcaaagtatttctgtgttcaattaaattaaagcgtgggcaaaaagaaattattag    132090
ttgtagatatttaaaatcaaatcagtttaaacaaaacactgtcaacacagcagccaaagaacataatcaa    132160
tcaaaagatgaataaatatacacagttatacagcactactactacataatgatgattatgatggtgatga    132230
tgaggatggtgatgaggaggatggtgatgatggtgatgatgatgatggttatgatgatggtgatggtgat    132300
aatatggttgatgaggatggtaaaagtgttggtgattttgatgatgttggtgtagaggatggtgaagcca    132370
tgctaatatgttgatgctgatggtgatgatggtgttggtgatgaggatgctgaaggttacggtgatgatg    132440
accagatgacgatggtgctgctgatgacagtgatgatggtgatggtcatgatgatgacagcaatgaagat    132510
aacaaatactgtgatgattgttttggtgataatagtaataactgtagtgatggcctgtttctacattgca    132580
atctctatttctccccccagtctccatacaaacagaaccaccttagagacatttcaaacttaccatattca    132650
aaatgcagctgctgcttttgatacaatgaatgcccttctgtcgcattttactatcttaggagaattcac      132720
accatctcctcatcatttaatgagccaaatgtgctagctgctgatccatgtgtctgaatggctgccttga    132790
ggaattggggtcctacagtgagcagcaatgctggactagggcaaggatgaataaagaagggatgagttca    132860
agttgttggggaaaacagggcagccaactctatctggagctctcagatgggcttagtgttggtgaagat    132930
atttccaaagacattttgaagacttggaggtatgttatcaggcagacagagcttctaactaagagcaat    133000
tttgacctgctgtacaggacagcctccaacccacacaatgatctggcccctaatgtgaacattactgag    133070
gtagagataacatgaggtagactataagtctatagaaaagagaatctgagcaaattgtgctaggga       133140
acactgaagaatgtggagcaattgaacaaatgcctgtgcagacatattggtacaaaattgcaatggagca    133210
ccaatgggacaggaaaagggacaagtcctacaatatacagttcttgaccatccctgaagtgcaccaaag     133280
ctacagaagttggtgtgcgtgaattgtctcattgatcctgtttggtaattaccatgttgactgctggagt    133350
cccatgaaggaacatttttaagcagcaaagtgacaagctctgatttgcattttgagattaatgactcaga    133420
caaccagttatttgttaacttgctggattcagcctaggaagacatctagagggtgtaatttgatttattt    133490
tgcagagggatgattggcctctacattatcttggtacactgcctgaatttctgaacaccacagaattatg    133560
tatttggcatatggccatctcatttctaagacccatcaaagatgtgagaatggattagatgtggaacaag    133630
ttgaagattagattagtttatcagatgattagcatgccatgctaatttatcaagacatgggatatttaaa    133700
gaaggggagagtaacatatgtatgtaacatatagaggggaagataggagaccctttgtctcaatttcttttt    133770
tcataatgaatcagtaaacctattggtagataaagtttagtttttaattctgctttctaagttaggctgca    133840
aaatattttttatcagtactctctgaaactgactgtcatgtcaagactctaaaagagtatccatagttat    133910
atttaaaaataaaatatcatctttttcatcttatgtagaacaacgtctgtttactactgcttggaatacaa    133980
agaggaatttagctgtggccattagaaagtgacaaacagtgtttcttccactatgtcaataattatagtga    134050
gaggaaagcatcaaaaagaaagttctttttatatacagttggcacaaaaatattcacatatgtaaataata    134120
taaataatgcaccataaaaagaaaaccttccattactattaacaaaattaatcagttgtcattaccatgg    134190
gatttaggatacatcttacatgttcttggttagattcatgagtcaaagaataatgcccaattgatgaaag    134260
tgggctgtaattttgtgcttttaaaacaatggcctctggccaaatatgggcaaaataaacaacatttgat    134330
ttattacttttacactgatttcttgcatcctgctggaaaagagagatgacttacaattataacatattttt    134400
cctgcaagattaacatcattgttgctcagttttatagaggaagtgggcttgcaatgatttatt          134470
atgaatgcatgaaacaattaatgctactagcaacagagtttaataggaaaaagttaaagcacacagtat    134540
taaaataaaaggggctgggtgcagtggctcatgcctgtaatcctagcagtttgggaggcccaggcgggc    134610
agatcaagaccagcgtgactaaaatggttaaacccatctccactaaaaatacaaaaattagctgggcatg    134680
gtggtacatgcccgtaatcccagctactcaggaggcttgaggcaggaaaattgcttgaacttgggaggta    134750
gaagttgcagtaagccgagatgacaccactgcattttagcctggcaacagagcaagacttcatctcaat    134820
aaataaataaacaaataaacaaacagagcaagacttcatctcaagaaataaaaaaataaaataaaaggga    134890
aaagttggtatcaaaattgtgtctgatttaggcaagtttatacctccatggatggcttttcataacaa    134960
taattgtattgacattggggcttttccgtgtttcagagattttcatgtggatttccaatatggtaaat     135030
atataatattgttatatgagggagtgatggaaaatcccatcaacgttggcattttttagaaagaaaagaa    135100
gcttagggaatattttaatgatttgggctaggtctggggggttcatgcctgtaattccagtgtttga     135170
gaggctaaggagggagaatgattgagctctgcatgtttgagacatcataggcaacatagcaaagcctca    135240
tctctacaaaaaacaaaagtgagctgagtgtgatggcaagcatgtgctggcaatctcacctactagggg    135310
aggctgaggtgagagaatcacttgagcccaggatgccaggcttcagtaaactgtaatcacatcactgca    135380
ctctggactgagcaacagagcaagaacctgtctcaaaaaaaaaaaaaaattgatattttctttcccca    135450
cagttgtcatatacaatgaaaactgtatatttaagccaaaataggttttgtaaacattaactattaaaa    135520
aagagtcaggcttgcacatagatacatgatattgcttttgatttcttcagttttcacctgccctggtatga    135590
gacccatgaagtaagcattcttctgggcacagaaattatactcctaaacgtattatttattaatatataa    135660
tggaaagagaaacatttcaaaaataaagacaaattaagctttaatgaaaagcaatcatacactgatgaat    135730
ttaaagttttggagcaaatactattgtgtttgatatctattagtctatttaactagtgaaatatgagcaa    135800
cgcaaaatcaaacatcaatagaaggttccaactaagcttgttctctcatatggtttctctgccagttcaga    135870
cctcaagagtacctcctgtctacaaagtagactctctgcccccacacactgatttccagcctttctgttt    135940
catggggtgacttgctgaccttctatgcatgggtaatagtactctgttgacaggcaagagttgtgtcttc    136010
cacttgggtcttctaatctgctaaagaaagcaacacacaaaatatagcttacaataattatctgtcaaat    136080
```

FIGURE 11A-27

```
ttacgtcaatcacaatgtggatggtagatcagtggtttctcttatgtcttgaaaggaagacttcaatttt    136150
ctctgcagccgtggtactttataaattatttcctcttccgtcttttaaaagtcactcttatttaccaccc    136220
cattagccacggattcagtgaaatgcccacgcatgcagtgttggagtcacacattatttcagaagaccac    136290
acagcagtaggtagtattaaataaatgtctgaaatgtgagccaggaatgtgttttttactggactgtcatt   136360
ttcttgcaggctcatttgtataattcactccagtgcatctcagttttatttcctattatgcaaaatagaa    136430
gataatgataggttagcacattctctgctgatactatttacattcgtgtaaatagatattgctaggggtg    136500
tgtgcctcagactatcccatccttcataggggcccatgtttcaattttctaataacccatctaagacacc    136570
taggcacacagggagaatactctgatttaaacagtccaccataagccatacacagtggtgcaccatgtg    136640
gtcccagctactcaagaggctgaggccaagatcagatgagctcaggagttcaacaccagcctgggcagta   136710
tagcaaaagcctatctctaaaaaataaaaataaactcaccactctgagttttacatgttgtaaaaatctc   136780
ccactggctcccgtctattatgcctggtttagtttgaaacaaaatcattagttttaatgtagcaaaattc   136850
catcgacatattttctttataagagcttctcctaagtagcacctgttagagaaatcctgttctacccca   136920
acatctaaaaaacattttcctgcacattttctataagcatcagaatttcattgttcatgcagacatttt   136990
taatctatgcagagcatatttttatatatggagttaggtagggatctcattttttttttcctgcagtaagg   137060
aagcattgcttttgacacatgaaagaaacaaggtatttttcccagtatttgttgtgtcagccagggtcc   137130
tgataggaaaagatggaatgcaacttgagaaatataaagatggggacagtatataggggcaccgacac   137200
agggtagtggagcccttatgtgaagttgctgatacccactgaggttgaactggacctacctacgagggag   137270
ggaactggatttcatatacataggcctttactcgccttctgtcctccagattacctactagtatcttcctt   137340
ggctgaaaccaagggacagccagaaggcaagagtgaactcacttatttaccttccacagtacagaatagt   137410
ggagatgagaaagagtaaatctggaaggggccagatcccgccccacccccacaaaaatacaagttttaa    137480
aattaatcatatatacatcagccaatcctagggcttatattggccctgttcatttgctgatctgtttc    137550
tgcaagatgaagaatgactcaaatattacaaatgacatatgttttccatcttcaacattcccctttgcttt   137620
tggtagaatttattctttcatgtacattatggaatcgatgtgtcaaagtgtgcaacattcttctgtctttt   137690
gctgggaattgtatttatttaaaagttggtttgaggaaaaataaacatcttctaagcttatgttatctca   137760
cttgtaaactggcatagtttattacttgttgagatctgatcatagctttattaaatactttaagcattat   137830
gtattaattaattattagtagtatttgcaattgataccttcaattacatttgtactcctggtata       137900
aaataatgttgttttttttacattgatgaaatgttcaaccatcctttggatttctattatttgtagcag   137970
ctttttctgttaaattacataattcccacaaaaatggtgacattatctgcaaataatgaccatttttctctc   138040
tttccttttaatacttgtaaattttaaatcctttctaacttctaccattgtatgacccattgacatctgg   138110
tgtgaggatgaatgctattgtacaaaattttattcccattcattgttttacaggaaatgggtctaacat    138180
cttttttgtaaaatacaatgtcaaggagagattttttgacatacagtcattttcaaataatatgaatttctt   138250
gtaattaccatttattttctaagttttaaaatgctttcttttgatcatacatattgattattgccaaat   138320
aagcagttggcatttctacagccgcttatacagctgcttatatcataaaagaattataattattcttcat   138390
aattagtgtgcttttataattaatagatttataaggtatctattcaatttagaaaaaacaaattttttcat   138460
cataataggaacaaaatggcctctcgtgttataagtggaatatattgtatattctaaaaatagccactatt   138530
ctactaagtttagtttgtaaatattcacttaggatgtctacatctacattcataagtgaatttgatttat   138600
aatttttatgatgttaaacactctatactttgatatgaatgttaaactatccatacaaaaggatttgat   138670
agctttattaatttatatttctgcagaaaacttcaatacataggattattaaaaattttctgaaaat    138740
tatcttgggtgacaagttttgttggtgggagattttaggttaacccttcaatactactaatagttttttagt   138810
ttaagtttattcttcgtgtaatgttgcttttttcttgacgatttcaatttagcttttaatatcaggtt     138880
ttatactgttaaaatattattttgtattttttatattttttgatttacttggtgttttaaaagtgattttcc   138950
tcttttcctttaaagactatttgttttcttaatttgtctcccttcctggtcagtcttggcagaagtttg   139020
tttatattataaagcttttcaataaactagttttcattttggtaattatatcaactcttttttctctatt    139090
tcactaatttctgctcctatcttgattatatcctatttttcagatttatttgtatttattctgttttctct    139160
tcttcctgccctcttcttgacttgtctccataggcttcttttcaattattcttgttgccttgtaaag      139230
gtatttgaagttttaattgtcccttaaagcacatcttcaatctcatctgacaaattttcacatgtgacat    139300
ttgaatgatccttggtttccaactattttgtttatattgtatcataaaagcatgtgcacacacccacac    139370
acaaacaaatacatatgcaaactaatgacagaatactaaacatatatatgtttatatgtgtgtaaaca    139440
tagatatgtgtatatatatatatgtttagtgttctgtgtccatagctttcaagcacacaccaaatgttta   139510
caaaatctaccttcaaaaagatacagcagcatacagcattgtattctatgaccataattcaatagaatt    139580
agaaatcaatagtaaaaagcgttcaaaataatgatagaacactaaacatatatgtacatttacatgtaca   139650
tacatgtttacgtgtgtgtgtgtgtatatatatatatctgtgttctgtgtgtgtgtgagagtgtgtgatt    139720
tgaggtgcatatatttccatagatagccaccggatcacacatgtcagttatttcagtcttctatatctta    139790
tttattttttggggtggcaggtgggggactctgtctcactcctcgctggagcagcagtcactcagtctcgg   139860
ctaactgcaatctctgcctcctgggttcaagttattctcatgcctcagccttccaagtagctaggattac   139930
aggtgcacaccaccataacctggctaaacttttttattattattttttgagacagagtcttgctctgttgc   140000
ccaggctggagtgcaatggcgcgatctcagatcactacaacctctaccttccggattcaagtcattatcc   140070
ttcctcagcctcccagatagctaggacaacaggcgcccgccaccgtgcctggctaatttttgtatttta    140140
gtagaggtggggtttcaccacgttggccagcctggtcttgaactccttacctcaggtgatcttcccatct   140210
catcctcccaaagtgctgggattacaggcatgagccactgtgcccagccaacttttgtattttagtaga   140280
gacggtttcactgtgttggccaggctggcctgaactcctgacctcaagggatccacctgccttgtcctcc   140350
caaagtgctggaattataggtatgagtcacgatttgtggcctgtatcttcaattagatttgtcttataa   140420
gttcatcacaccaagaatgttgagttttattctcttgtaacatttcatcttatcgttcctttgtctggta   140490
tatttaatgcatatggatatactatgttatatatatagtatgtataaacatgtacttacctttac       140560
atgttttcaagcttattaggaagttatatgaaagtgtcagttgtaccttttttaatcttccattcctttc    140630
tactatttattatctattattgatatttatgatttggtttgatactaaatttgcttactatgattttt    140700
ctttacatatttcttacatttaaattttagtctcttcctgttcgtgtatctgtttgttttaaatatat    140770
ctgtttcaacaatatgttgctaaatgtattttaatcacattttatctgtttatcctaattatatttctg   140840
cagttatcattattagattttcatttctgccactttgttttttatatttatgtatcaatcatgctttt    140910
taaactttaacttttttttttttcctgacttccagtgtataattttaaaagtttctcttactgacctcatt   140980
attatactccttttttgctgacctcattattatactctttttttatgattttttttcctccttatagttt    141050
ggattcatcaaatttcctgtttatgttgcacttatattctaatgaagtacatcgattcttcttattgg    141120
ctatcaaacttttcagtatccacaattttcctcagaataagctatagatttaagattttctcaactcttt   141190
```

FIGURE 11A-28

```
ggcatctctctctctcaatcaccccacactgtgttagattctaagggaatttgggctgtagatcatgtta    141260
aaatttgattttagaatattgtgtctttggagtaatgtcttgtcattacttgtattatactgctgtattc    141330
tgggtttatttctctccttccttgcagaaatacgttgtttcaagatttctaagaattaaatagatttgga    141400
tttaagctatcatttaaataatagtttggctggacataaaacctaggcagatctttttccctgcactt    141470
gctggggatgagaagccactgctttttgtatcctacactgctttgttgttaccccgattttcaatccatt    141540
gcacatcacctgcttttctcattggaagaattagacttactttgtttatatttgagatactcaaaaatc    141610
agaatttagttttgctttttttctgttttaaatcaacctgttccttactttatgagaacttttccatttaa    141680
gccttttttttttttttttccctctcatcctgggaacttctcagcctttctgcctaatgtagttcttgc    141750
taaccttttctctttgttctctttctgggtcttttttttataggactggcaacacttctacttccatct    141820
tccatacttcagcatttggaggatgttttcctccatttttcatcccggatccatttttgggaaagtgtct    141890
ctctgtcttttgccaccaatatgcattgtttgtaggtatctttccatttcagcctgttctttgtgctctc    141960
cacttcaacaatttcatttctcctcccagtttctcatgtgacttcctttgacaccctttgttccaactt    142030
tatatctctataattgtctctctgtccattggacggatatttaatctacttattttgagtcccatgttgt    142100
ttgcttgggtcatttgatagttgttgttatttcatatatgatgttacatttgtttaagtgtttttgcttttt    142170
tgactggctctgaagtatttcttgggagttttttgttgtcgttgaggacagtagatatcttggaagataa    142240
tgagtatccaatggccagtcaaaagcccaccctcagctgggcatggtggctcatgcctgtaatcctggta    142310
ctttgggaggctgaggcgggcagatcacccgaggtcaagagtttgaggccagcctgatcaacatatcatt    142380
aaattagagctttaagttatatcactgatttcatatgccagggaaaattgtaggatgtggcttacaaggc    142450
aatctcacaagaagtatgacttttgtcttataaacaacaaccaaccttgggagtttgttccagtaaattt    142520
cataaatataaaataaactatataaataaagtaactaatatcctactaagtcttttccctcacacatgct    142590
ttttttgcctaaagccatttaaagtctctgaggatttaaatctataattctgtcatggagtggtagaaac    142660
ccagagaatatacaaacgttgaaaaacttttaagagtcactggtttaacagaagttggctgggcttactgg    142730
ctcacgcttctaaacccagcactttgagatgcgtagctgggcagattacttgagggcaagagtttgatac    142800
cagcctggccaacatgatgaaacctgtctctactaaaaatacaaaattagctcggtgtgggggtgcagg    142870
cctgtagtcctagctactttggaggttgaggcaggagaattgcttgaatctagggtctgagtttgcagt    142940
gccccgagatcacagcaatgcacttccagcctggtgcaacagagtgagactccatcacaaaaaaaacaaa    143010
aaacaaaatgacaacaacaacaaaaaaaaaaaaaaacagtaaaacagaaatagatctaattttttcagacta    143080
gagtcactcagatatggatggataagtccatccactatttgtgtattaagctttttttttttttttga    143150
aacaagtgtattcacacttggattgactgttaatattcactccaaactaggacattgcaaagaaccctta    143220
ggatgttataattctaggcattttatagtctcagaattcagatgtattgcaatgttgtaatttttat    143290
agtttcttgtcttctgtaacacctagtaagttcaaaaactcgaactataggttttcttgataaatacca    143360
gcgtcactgctttctatgtttatattttcttttaatacatgaactgagttaaaaattaaatatacatat    143430
gtaaattattcttttgaaaaaatattacttataatagttttttaaaatacatgtttatttaattttagatt    143500
tctgctaaattgtgaagattgtggaaaggattttccttatacccccacccttgaatttccttctataaa    143570
tatcttaaacatcattattatacatttgacactattaatgagccaatatgtacaatttttttttgactaa    143640
agcccactcattcttcagatttctttggtattttcattctgtctttttcctttcctcaaacccccacccca    143710
gatcccacattacatttagcggtcatgtctccttgggctcctcttgattgtgatgatttctccttctcat    143780
tttgtctttcatggccttaagagcttaaggaggactaatcagggattggtagactgtcctttttgttgg    143850
gtttgtctgatgttcttctcatggttattctggggctatggattgtgcagaggaagaccagaggtgaagt    143920
gccactttccttactttgtatcaagggcacatactagcaccatgacattgcagttgatactgaccttgat    143990
cccatggatgaggtgatgttggccagatttccctactatcaagtactcctcttgcacacacactttcca    144060
tattgtactctgtgaaaagatgtcactttgtgcagcccacgcttaagaaatggggacctgctattcccc    144130
cggagggcagagtatctacagaaattacttgaaattattttacataagagatgtctctattctgagccac    144200
tcatttactccctcatttacatatatcagtatggtcttatggatatttattttatacttcaggttgaaat    144270
ctaatatgatgttgttttatctgcatagattttgtgtttgtttttagtagatatgaggtctcactgcttttg    144340
cccagggtgttcttgaactcctggccttaaactttaaaactttaaaaagagggatagcttttaaaaat    144410
cctcatttttactttagatccaagtgttaaatatgcagatatgttacaagggtatattgtgtaatgctga    144480
ggttgggcttctctgttaggttattctgtgtccaaataataagcacaggaagttttagtccttgtcccc    144550
cctcagtaacagcttgtaggaaataatttgagactgatcattttttaattttttaagcgctgaacatgcagt    144620
tatttatctggaaggtagactagaaaacaaaattatatttgacattttaggacataagtgttttctca    144690
ttaatcttgatgtacacaaagccagattatcaatgtatttgttcataactctagcttgtttcattaaaat    144760
tattttcctgcaaagaaaacgccttttttgctaccctgaatatttaacaattttttagaatattttatcttt    144830
aagagctataaacatgtttaatatccaaggtaagatatggagattttgtagtctgtccagcctgctg    144900
tagcagaatacccttagactgggtaattatataaacaatagacatttattattattattttcattgagacag    144970
ggtctctctctgttgcccagactagagtgcagtggcttgatcatggctcactgcagtcttgactttgtgg    145040
gctcaagtgatcctcccaccttagcttcccaagtagctgggaccataagtgtgtgccagcacacatggct    145110
aaattttattttattaactttagtaaatatgaggtctcactactttgcccagggtgttcttgaactc    145180
ctggccttaaacagttctcctgcatgactccccaaaatgttgggattacaggtatgagccacttaaccc    145250
agttaaaaaccgacatttatttcacacagtcctaggaagtccaaagatcaaggtgttagctgattctttg    145320
tctggcgagggcccattaccccacatggcaccttcttggtttgtcctcaaatgatggaaggggaaaagca    145390
gcttcctgcaatctcttttatatggacactaatcctattcatgagagtggacttatcacaatgtatattg    145460
gatttcagcatatgaattttgggaggttaccaccgttcagacaatagcaagatacattaggtgtggggtg    145530
ttctggacttggtgaatctgtgtaagtccttcacatgtgctttactgcttggggtagctatttc    145600
tgcctcaaaccacctcagagggcttcagatttcagtgacacacctgtcactttaacgcacatccttgaa    145670
cctccgtctgtgtgcagattaagcaacaggtgattttaaggttcaggcctaaggtttttttattattgcc    145740
tttcatttccatttctagttcttccaaaatccttcaaaatgacacctgagaggagacactcataaacttg    145810
ttagccaggattccaaggtacatagaagctgtttctcctgggtgaatattacaaatgcctccaagggcaa    145880
ttgaatttctttctgtctttcatggattttacttattgtccagatatgctcctcctagtgagaggggtca    145950
cttctgattttcctgcctccacagaacaagggctcagaggagagacactctacagctcctttgttatt    146020
aaattattaaatgcatttctagtatgaaggcagcctattagaaaaatccagtctgctgcatatctgttta    146090
tagggtttgagcccagtcaagtgaggatgcacagaattccaccattctgacagcccagccccttgcaat    146160
tggaagggtctccaaattccttccttgcagctagggttactggctatgagtgacagcctcttgtgcatag    146230
ggagtgagggcggagagggaccagcagagccctggaatgtcctttccactggacattgagcatctagaca    146300
```

FIGURE 11A-29

```
gctcagactctggaatagcttgtactataggtgcatgctaccatgtatggtaattttattttgatttt      146370
tgtagacataggggtgtcagtattttgcccagattggtctcaaaaatcctaacgtcaagcgatcttcctgc   146440
cttggccttccaaagcactgggattacaagtgtgaaccactgtgcttggccataacctatagtttttgtt   146510
agagattattaaataaggatgagattaaaatgaggttagtctcatgctgcttaaaacagtgatatgctta   146580
ggagcagctgcaggaacatctgatccaatcttggaggcagcctgaagggcttcccagggaaagcacaatt   146650
taagccaaaacctgagagatgagcagggattgaccaactaatgagcagacccacacaccaaattctgcag   146720
tcagttccttgcatgacatggaaaattgatttctacaactatgcattacttttctcccaccaatcccccg   146790
ccctgctttattttttatctttatttctactgggtctctgtcactcaggctgtagtgcagtagagtgatc   146860
ttggctcactgcagcctcgatctccttggctcaagtaatccttccacctaagcctccctagttagaatag   146930
ctgagactgcctacgcacaacaccatgtcggtccatttttttttttttttttcttttgtagagatggga    147000
ttttgccatgttggccaggctggtcttgaaatccttggctcaagtgatcagcccacctgggggttacagg   147070
caggagacaccattttatttgcatgtgtgcggtcagtcattctacaactaataatatttaataataat    147140
tgaaaatatcctgtaaattccaaaaaggtaagcttaagttctcttgaaaatgaatttctgtgagaaggc   147210
tttggtggtttgacttgaagctgataacaacattagtgttgggcattttggctacacacctgtcacattca  147280
aaatccaatctattttcaatctttatttcggtggcagtaagtgctgaagattttaatccactatgtattt   147350
tcctaacccagattctactcaaagcagaggtttagagaaatcccttgtttattgcaaatatcatgccaag   147420
aataaggatgaggaaccagcacagtgatgaagggagaaatgtaatcactatttacaatagccaagttgtg   147490
gagtcaacctatgtatccatcaaccatgcattggataaagaaaatgtggtacatatacaccaaagaatac   147560
taggcagccataaaaaagaatggaatcatgtcctttgcagcaacgtgcatgtggctggaggccattatcc   147630
taagtgaaataactgagaaacataaaatcaatatcacatgttctcacttataactaggagctaaacaat   147700
gggtacgcgtggttgtaaagatggaaacaaccaacaatggagactcaaacaggggaaaggatgggagggg   147770
gtgaggtttgaaaaatcacctatgggtacagtgtttactcttgtgtgattggtaccctagaagcccatat   147840
gtaaccagtgtacaatatacccgtgtaagaaacctgacatgcaccccctgaacctaaactaaaattaaaa   147910
aacaaacaaaaaccacacaaaaaaattgtattggccacagaggagagatgcctgcttgacccagtgaggt   147980
tgtgtgaaaacccttatgatatatgtccccataccacttcccaggtgaaaatggaggacccacattctc   148050
ctcatctttcacccttaataatgtactggtgttgacatctccaggctacttggggagtgctaagtaggtt   148120
ttagtgtgcatcccctgtaaggcattgaagaaaattcaggaaatcaagaaaaagtcaagtttccaggtat   148190
gaagagaggctgcaccttcatgaagctggttgaagtctggacagagcagatcaccacaagagtgactgga   148260
ataagccatgtggccaagaggcatccagtgcagccatcaagtgaaacagagctcttccagccgtggtaga   148330
actagggtcaaactatgtgaaagtgttcaaagattcttttgcattgaattcaagctcatcattcacttgcg   148400
ctcaaatctgtgagaccatgtttatattgtaaagaaaggataaaacataaattcatatttcaattttag    148470
gttatctgaatgaatggatttcaagagtgcttaagttttttcctagatgttcacagcttttcaaatcatc   148540
ttcctcagaacactgaatcctgctaattgagtgattttctgattgtcatgtactcacacaattgactaaa   148610
tgtcttactatgcttcttgataagtagtgtctacatgtgaagaacctatctatttaatctatctacctg    148680
cctatatatctctatttctccatctagtctatcaatctatcttatctataatctctatgtatcatcta    148750
tctgttatctatctatctatctatgtctatcttctctctttctctctcctctctctgagttgagca       148820
aattacttacaagttttttgtcatgtaagtgagcaagactatatacacacacatataagaaggcttgaact  148890
acaacattaaagtggctgcagattcagtgctcggtggggaacccacttcgttgtccatagacagggccttc  148960
tcactgtgtcctcacatggtagaaggggcaaaggaggggggcctctctgggtcccttttataaaagcactc  149030
atctcattcatgaagctccatagttatgatcttatcacctccaaaagtgctcgcctcctaatagtgtccc   149100
ctcggggattaagatttatatcttttgttttaaattttaatttctatatgagtacatagtaggtgtata    149170
tatttatggggtacctgagatattctggtgcagacatgcaatgcgtaatgatcgtatcacagcaaatggg   149240
gttgtctatctcctcaaggacttgtcttttttgttacaaaaaatccaattgtattatttcagttaaaatg   149310
tacaatcagtttactattgactaaagtcaccctgtcatgccagcaaatactaggtcttatttattctttc   149380
tgactataatttttgtacccattaaccatccctactttcccatcctactcccactatcgtttccaatgt    149450
ctgataaccatcttttgattctctatatttatgaattcaattgtttcaattttagctcccacaaataag    149520
tgagaacatggtataacggtctttctgtgcctcgcttatttctcttaacataataaccaccagttttatc   149590
catgttgttgtaaatgacaggatctaattctttgctatggttaatagtacctcattgttgtatgtgtagc   149660
ccattttctttatcccattcaccgttgatggatggttaggttacatccaaatcttggctattgtgaacag   149730
aattgcaacaaacatgggggtgcagatatctcttttgatatactgatttcctttctttgggggtttggatg   149800
taaacatatgagttttgagaggacaacattcagactgtagcttactgtactatctatccattcatccacc   149870
tgtttatctattccatttctaaatattgcatggcatatttcttaattcttttccaatgtcttattgagtt   149940
ttaatataagtttacgtttctgataggccacatatgggggcatcctgaaaagtacatctgaggcaggtca  150010
ggagtttgagacgagcttgactaacatggtgaaacctcgtctccactaaaaatacaaaaattagccaggt   150080
gtagtgggggttgcctgtaatcccagctactcaagaagctgaagcaggagaatcacttgaacccgggagg   150150
cagaggttgcaatgagctgtgattgtgtcattgtactccagcctagggtgcagagtgagactatgtctca   150220
aaaaaaaagtacattatctttatattttaaatgttttgggttttttctttattttttttcatatttaatt   150290
acatttctttcaaatgacttctttgggaagacatgatttttgtacctcctgagctgccacaattctcctg   150360
cctcctgggatgtgatcgatctctagtctgcctcaagtataaagatgatattcatgttgatgacattgag   150430
aaggatgaggagaaaggagttgatcagagatctatattcatggtatacttgtttgccatgtctgcttttc   150500
ctcttcagaatgtaaactccaagactgtgggtctttgttttcttcggtactaccttgcagagtctaggtc   150570
ctattcaaagcttaatatttgtgaagtgcatgaatgaataagtggattataatattatcaccaccattgg   150640
tatggcttttgtttctctatctgttcctctctactttcttaattgtttaattcccacacagatt         150710
gccgaagattgctttgccaactgtccctgggtagagataaaattccctccatggtgcttctcactggactc  150780
tacctgcagctatatattatcttgcattttctaacacccagccccaccacataatagacttgattgatt    150850
gaagaccctgagttagctttgcataaaaccaaggtgctttccacacagacattcacagacattttcacat   150920
ttcatacagcaactgatgaactaggctggaaatacacttttttactggcttaacagagaagaaaacaaagc  150990
ttagggagactgattatgcaggatttaatttgtaacaagcaaagagaacacttattgacttcaagtggaca  151060
tcaacacattatcatctgataattttccagcatcctttgcctcatctgttaaattataaactaatgctg    151130
atgtgtacaattcagttcagcttcacaaatatttaatgaacactcgctctataacaggtattattata     151200
aatagttctttatgatgtaagaatgtttaatagatacttttatccattcaactttgaaaggctaatgcc    151270
tattcatagataccaggaaacacttgaatgaatgaagacatgttttctgctgtcaaagagagatcagaca   151340
ccaacaagtggccaagaaagaacaaagtaattttgatcaacaaaacttatagaagaaaataagcattctt   151410
```

FIGURE 11A-30

```
tgttgttacatatacttcagagccatttagtgctcaaagtttgatagaaattgatacacaggacttgcg      151480
cctctgaattggctatcccggaatattctatgagctacaaccagatttaacattaacctgtagttacttg     151550
tggtttattcatctatccacctaaacactatgagcaacttcaatgtgctcttcatggtactcgactttag    151620
gcattgtatatggagcaaaatagacatatttttcttatttattgtggcttatactcagatgcagcatttct  151690
tcaccagtggtaattttgctcctgggacatttggcaatgtgtggagacagtgaaggttgtcatgactgg    151760
gtcttgcttctggtgtctaatgggtagaggccagaactccttcacaataaagaactatctgaccaaagaa   151830
tatcagcagtgccaaggttgagaaactcttctaacggttggagaaaaatgatcaatggatcacctacaat   151900
tataattacaaactgagctatgtgttagatgctagtagagctgatttccaaggttactgatctagtcatg   151970
aggatacatattgatactaaggacatgtggttgaagggcaggagtgatttattagggtaagaagttcat    152040
ggtgagcagagggactgtcatgcaaagactctagggcttgaaggagcccagtgcaatcaggatctgaagt   152110
gacaggtgtggcttgagaacagagaggcaacagggagttaggcagaagggggaagctggaaatgcaggcaggg 152180
gtagaaaataaaaatatgccagccatttatattacacaattctgtagacttctttcttctttcattcttg  152250
atacttttctataataacattcaagcattggatcagcacccttgttgtcttctgtagcccaaaggttga    152320
ccttggagacacaaaggcaactatgacaatggtttctgcaatagggagatcacattctcactcagaagac   152390
atttgcagggtgtgattagtgattctcacatacatgtcaatttcttcctcactcagaaagacctgtgctttttagt 152460
ttttattttaatattattattgttatttatatagttatttgagagaatttgctctgtcacacagactg    152530
gagaccagtgttgtgatcatagctcattgcagcctccaactccttgtgtcaagcaatcctcttgcctcag   152600
cctcccaaatagctgggactacaagcatccaccaccacatccagcttattgtttattttttgtagagaa    152670
ggccacctctacaacttatgttgcccagactggtgtcaaatgcctgggctcaagcattccttctgcctga   152740
gtctaccaaagtgctgggattctagatgtgagccatgaaaccctaccttctggttttaattggcttatt    152810
ttcttcgcacatttcagtgaagcattattcatttatcgttactgaggttttactttttttttttctttccc  152880
agagttagatttcagacaactcaccttgttaccaatttgaaatgctaggtgtcaattcttaatatagtt    152950
gtaaagggccatgacttgaggatatgttattttttgggcttgagtttggattggttttgagttgaatgca  153020
attgctaagccattgaataagggaacattgctgaactagatgacatggatttatttcttataggtgagag   153090
tgcatttgtgataaagtcattgtttaggatacataagggtcatgtgtatttttcttggctagtgctatg    153160
aattcatttgtgctatttcttttgaatttttgtatttctctactctccatcttattaaaccaggtgtttc   153230
aggtttgaggttctgcacatttttctctggggttacacagagggactaaataggtggagtttagggtaag  153300
gggatattcacagtcctgccctcctgcaaccacagcaacaccccaaagtctctcataagactgtatttgt   153370
tctcctacttacattctttgaccactattatgaacgttttcaatagtctatccaatgaaaacaatgttgt  153440
caatgactgtctttagtaagtctgtagtcagattcatatctttaaaatatgtacactgtgtgaatatttc  153510
aaagtatatatcatgaaaataaataagaaaaaaaaaacaagaaagctgagatagctctattaatattaga  153580
caaagataccttcaagaaaaggagtatttccataataaaagagagatagtcataatgatacaaggaagaa  153650
tccacctgacataactaataattttaatttgtgtacacctaataagagagctgtaaattacacaattaga  153720
cagcaataaatgcaaagaaagacccatcaatgatagttggagatgttaagatgttaccaaaatagat     153790
gaaagatgaagtbggaaaacacacacacacacacccccacacacacagatacatacacacataaatac   153860
agggaggatacacacacacacatacatgcaggaggatgaaaattttcaacaacactttcaatgccct      153930
tggcaagtttgtactttgagtccaacctcccttcacaattcaacaaagagacaaacaacccacaatttta   154000
ctgcatttcatgcttaggttcccggtgtctcaaggcctctggccagccatgtgtgtacaggaacacacac   154070
acatcaaataaacagaaaaatgaatgtataatcgcagactgtgattaacaccatagatgaaaatcagaga   154140
gggtgtgcagtcattaacaggcaagctgacctcacctttgatacaaagacacaatggtgttcaggcgaaa   154210
agcaatgaataggtgttacccagttggggagataagaatggtgttgtaagagtaaggtaaatttgtgcat  154280
aggattccagttggcacagatttttagtgcagaaacaggaagtggaagagggacagggttgaggatgta   154350
taattcaacagatcattcaggtccctgttggagaactttaagcagggctctgtcaaagtcagtttggtca  154420
ttttgatagatgactctgggtggggagtgatggcagaatgagatggacacatattaggcagtcacttca   154490
tctagcagagacactgacagcctggaccataatgacgaagatggagaaaagttatatgaacctatttgag  154560
agatatttcagaaggaaaccaaagatgtgatactgagttaccctggaatgtgggaaaggaatggaaagttg  154630
gatgacctttccatctagtttctgtgtagattctgtgcatgatcccttggcttaagacataagcactgtg   154700
agattacagataatctatgatttcatgtaaagagtttcccttttcttagatttccatctaaattg      154770
agattattgtctttcactgcatgtaatctcattactacctgatttggaatgctattccttatacaagca    154840
tgttgtgagaataatgcttggtgccaaatgttacgcaaatagtattgatttaaatgtggtaacatagata  154910
actgttaacatatgtacaatagataacacaagtatataacatataaatatcatataatatagcttaatta  154980
atataaatgaaatatactggggaggaaaatctgaaaggtgttaatgacttagggaccttatcaatatata  155050
tcaatcattctcacactgttatgaagaactacctaagcctggttaattgaagaaagaggcttaatt     155120
gacatgcagttcttcatgctgtataggaagcatggctgggaggcctcaggaaacttacagtaatgattaa  155190
aggtgaagggtaataagcacatcttaccatggcagagcaggagagagaccgagccaaggggaagtgct    155260
acacacttttaaacaaccagattttgtaagaactcatgaccaccggaacagccaagaggaaatccaccc   155330
tattatccggacacctgccaccaggtcattcccccaacatttgggagctacaattcgatatgagatttgtg 155400
tggtgatatacagccaaatgacaactaacctctcataatgctattgctcatgatgaataatatcctttga  155470
ggacaaaatgtcattcaaaatgtgataataatgttgataataattaatgcaagcctaataaacattctct  155540
gtatacatttgtaatacattataatatgaattatattcagtaataatttcacttaaagaataatttaaa  155610
atataacaggcagataactataggtaatagtttaaaacataacactaaaacttgcatggttttggtattt  155680
caaattttacgtggattctactatatttcaaggacacaacgaacataactgaaggcaaaccttgaaatt   155750
ttactttctaaatctgattactttcttaaattttactttcttaaatgtgatgagttgtgttaatttatt  155820
tggaataattaaactcggcattatatattcttttttatgatgtcattaataatgtttaaaagtcaataac 155890
acatctattgctactttggttaaaagctacatagatagtagtagctatggtacttggatgaagaagctg   155960
aagtttattatttttctttctaatttaatccctaagggtctttgataaaagacttacacaaaccccc   156030
tttagtaacctaatcttgtaaaataatcctgttcttaaaatggtgatagagatttgcttggtttatgcta  156100
cgtaacaccataataacacattaagacttgattctctttatatcatggagcaactcaggtagtgttacaa  156170
agtgctgttactcaataaatgtggtgaagagcaagctctccagagcagtgccatgcctgtgtctgatgct  156240
ttccagtatgtgaaaactgctcagatactaatggtttgtttcaggcgcattgacagcctgatcataggctc 156310
tagccatgtaccatgaaaatggcttctccaggggcttaagaaagacgatgaagagctttgcattttctc   156380
ttggcatttcctgctattgttaaaaaggtcacatatgcaatttaaaaatgttccatgcatggagcatgac  156450
aaatgccatgtagaagataaaactgctttcattgacatttttggccaatttccaaacggtaccatttcc   156520
```

FIGURE 11A-31

```
acattttcccctttgtggatttgcaaaatttggcttgtgcaaaatgcctgcccacaatacagtctaagtt    156590
gagaaatgctacatgttaaaaagcaaactgtgtatagatgaaaatggcacattcagaataaaagtaagaa    156660
attaaatgccaccaaaaaataggaaaaacttgtaaatgagtctatcaaaactattaaggaatctcaaaa    156730
tgaaagaaaggcttagaactcatcaataacaatgtccaattgcattcatatgtaaagaaagtaaaatcaa    156800
ctttatgttattttagttcactttattttattcttattatccttttacctagttgaatggcaaaactaaa    156870
tttagttatctttgggcattgaaaaatgagtactctcacagtttgatagatggaggaagaattaaggtag    156940
agttttagaatttgagtattatacaataaaatttaaaaagagacccactttactcctctggaagcacttt    157010
tgcttccaggaacctatcccacagatatatgcagaaagatgtatgtacatagatgatcattgcaactgaa    157080
atttatctcatcaggaaaaacgtgtaaatgaattttttgagcacttagaatactaaaactatctttccct    157150
tgaaattgtagaggcaaagcaaaatgggaaggcagagaataatacataaatttatgtaagcatgtataca    157220
tactggtatatacacatagatatgaatgcacaattgtatgcatagacatatgtatacatacatgtgtgtg    157290
taggtgtatgcttttgtgtagatttgtatacaaatatgtatattttactgcacagaaaatgtcaagaaa    157360
taaattattagcaatgtttagaatgggactatgttactgtgccttacagagaggccttgattggcagag    157430
aaaatgaaaactataactgctcctatacttaagaattttaaaatcctttgtaatgagtttgaataattt    157500
atttatattacaattatgcaaatcttctatgtgtgtataagaagccattagaaaaagatggtttcatgtg    157570
atagaggaaactagcataagttagaattttgactcagctgatgagaaagtatttgcccaaagcaatctaa    157640
tcaaagctctgttgcatgagcctggtgtggtgagtcacacctgtgactgctttgtttgggagaccaagga    157710
gtgaggatcacgtgagaccaagagttcaagaccaggctggtcaacatagtgagatccttctctacaaaa    157780
agtttaaaaaattagctggccatggtagctcatgccttgagtctcagctatgcagaacgctgaggtggga    157850
gtattgcttgagtccaggagtttgagggtgcagtgagctatgatcaaaccactgcactccagcctgggca    157920
acagaacaagacccatcctttaaaaaaaaaaaaagaaaaagaagaaagaaaaacgctgggcatggtggg    157990
tcacacctataatcccagcacattgagaggccaaggtgcgtggatcacttgaggtgggagtttgagacc    158060
aatctgaccacatggagaaaccccatctctactaaaaatacaaaattagccaggtatggtggcggtgc    158130
ctgtaatcccggctacacaggaggctgaggcaggagaatctcttgaacccagaaggtggaggttgcagtg    158200
agccaagattgtgccattgcactccagcctgggtaacaacagtgaaactccatctcaaaaaaaaataaaa    158270
ataaaaataaaataaaaattaaacactttgttgtgtggaaaaaagacatatagttaaacaaatataacca    158340
gcccttatttctgaggagaaagactgatgcattgtagaaaggataatacaattttgagatttaggtaag    158410
gactatcagaatttccaggaagctctgctgttcattgttacaggaaattactcaagggaatatatg    158480
acttggaatcattttgcttttttgttacatttcctattattcattgcttctttggactggtgagaagcct    158550
ctcagagaaataaggaatactgcacatcctccatattttctcagcttttgaaaattaagttttatacact    158620
taagggcagccacaacacatgaaaacatttatgctgggcgcggtggctcatgcctgtaatcccagcact    158690
ttgggaggccgaggtgggaggattacgagatcaggagataaagaccattctggctaacatggagaaaccc    158760
tgtctctactaaaaatacaaaaaaattagccaggcgtggtggcgcacctgtagtcccagctactctg    158830
aggctgatgcaggagaatggcatgaacccaggaggggagcttgaagtgagcagagattgtgccactgca    158900
cgccagcctgggtgacagagcgagacacagtctcaaaaaaaaaaaaaaaagaaagaaaaaaaaagc    158970
tcatgggtaggaagaatcaataacatgaaaatggccatactgcccaaggtaatttacagattcaatgcca    159040
tccccataaagctaccaatgactttcttcacagaattggaaaaagctactttaaagttcatatggaacca    159110
aaaaagagcccgcatcgccaaggcaatcctaagacaaaagaacaaagctggaggcatcacactacctgac    159180
ttcaaactatacaaggctacagtaaccaaaacagaatggtactggtaccaaaacagagatatagatc    159250
aatggaacaacagagcccttagaaataatgccgcatatctacaactatctgatctttgacaaacctgaga    159320
aaaataagcaatggggaaaggattccctatttaataaatggtgctgggaaaactggctagccatatgtag    159390
aaagctgaaactggatcccttccttacaccttatacaaaaatcaattcaagatggattaaagacttaaac    159460
gttagacctaaaaccataaaaaccctagaagaaaacctaggcattaccattcaggacataggcgtgggca    159530
aggacttcctgtccaaaacaccaaaagcaatggcaacaaaagccaaaattgacaaatgggatctaattaa    159600
actaaagagcttctgcacagcaaaagaaactaccatcagagtgaacaggcaacctacaaaatgggagaaa    159670
attttttgcaacctactcatctgacaaagggctaatatccagaatctacaatgaactcaaacaaatttaca    159740
agaaaaaacaaacaaacccatcaaaaagtgggtgaaggacatgaacagacacttctccaaagaagatat    159810
ttatgcagccaaaaaccacatgaaaaaatgctcatcatcactggccatcagagaaatgcaaatcaaaacc    159880
acaatgagataccatctcacaccagttagaatggcagtcattaaaacgtcaggaaataacaggtgctgga    159950
gaggatgtggagaaataggaacacttttacactgctggtgggactgtaaactagttcaaccattgtggaa    160020
gtcagtgtggctattcctcagggatctagaactagaaataccatttgacccagccatcccattactgggt    160090
atatactcaaaggattataaatcatgctgctataaagacacatgcacacgtatgttttattgcggcattat    160160
tcacaatagcaaagacttggaaccaaccccagatgtccaacaatggtagactggattaagaaaatgtgtca    160230
catatacaccatggaatactatgcagccataaaaaatgatgagttcatgtcctttgtagggacatggatg    160300
aaattggaaatcatcattctcagtaaactatcacaagaacaaaaaaaccaaacaccgcatatgcatattct    160370
cactcataggtgggaattgaacaatgagatcacatggacacaggaaggggaatatcacactctggggact    160440
gtggtgggtggggggagagggagggagaatagcattgggagatataactgctagatgaggagttagtg    160510
ggtgcagcgcaccagcatgcacatgaatacatatgtaacctgcacatgtgcacatgtaccctaa    160580
aacttaaactataatcaaaaaaatggcataaaccttttaagcacaaaaataaaataaaataaaaataaaa    160660
taataaattccctcaaaaaaaaaaaaaagaaaagtttatttcttcctcaaaccttcttttacctagcctcac    160720
tcaaaccaactcttaattttttccttttttttttttttttttttcccaaagctatgcagctgacacgc    160790
atctgctcacttggcataattcagttggcatccagtaagtttaagaaattctatctgggattcatgcaat    160860
cacaacccacatccaaaaaataatagcagcacttataataaataataatagtgttttttgtttgtttgtt    160930
tttttagtattcacataggttttctccctggattttcacaacattgaaacaaaatagacaaaataaatgg    161000
gcttctcttcagccctgagttttgcctactcttaacccttttggagaaaaatggcactgagctgtcagtc    161070
agtcgcctgtgggagaagacaccagtgtagatggctttctgaatatattgacttgatttctatcaccaa    161140
caatggcatattcaggctgtgctccatgccaggtgccatgtggtcatgagtctaccacaccagagtgat    161210
tctcagaagtagtattgaaaacacataggcaagcattgcttaagactgtataaacataagctctgtccag    161280
acatggaatacagtcggagtttgctaggataatcccaaataccaatacaccagaaaacttactatagc    161350
atgagtattgaaggcaaagatgctttggtatgtaactaaaataatagcatgaacccatcttttagtgtg    161420
aatattgaataattaatgttacatacatgaagctagcatgtactggaaggactcaaagtaactgaaaact    161490
atacatttcttcacgccattttatttaagacttcagctccctttacacaaccatactcagttaccttttgcc    161560
tgttcctgacttactaagggaagatggtgtggagctacaatttataatccagataatgattactagagtc    161630
```

```
catactctaccctgaatactgaaaactgcaataatgtccctaacttaaacttcctcttctgtttatcact      161700
tcttccttccctctttgattgttcttccatgaatccttgcaagtctccaagcactgagtatccttccatc      161770
caccaaatgtctgatatagatggctgggtgtaactttaagtctctcactaagatgatcgatttctcctc      161840
tgcttgtgctgggctcaccctctcatttctcagccaagatatcgatttattgtgtcccatagcactgcta      161910
gcattaatggaattattgcatggtttggcctcattttagtgtgtggttttagaaatatctgagatctt      161980
agtgttggtttgcaatctgtcttagtccttctgtgctgctatgaaagaatacctgaaactggtttataa      162050
aacagaaatttatttctcatagttccagaggctggcaagtccaagatcaaggcaccatcatctggcaaga      162120
ccttcttgcacatcatcaaatggcacaggggtaaagagctgaagagagagaacccactcctgcaagccct      162190
ttttgataatgatattcatctattcatgaatttaattaaattcaaactattcatgttcattacctaaaca      162260
tctcccattaccactaacccacaaaacactgtcttattagggttaataatattcatgacaatgcatga      162330
attctagggacacattcacaccatagcaaaatccatttacactctctcctcatcaaggtttatgtgtttt      162400
ccaaagtgagtcagttcaagttttttttgaccttcctcttttgttttcattagatctcattttagacta      162470
acagattactttgttcctataactcatgtgtctttcagaatctgggccagtttccactacccaagtggga      162540
tctaggagttaaccccaccgtcaacccaagtactcctcctgtgtccaatggccagtcagcctcaatcctg      162610
tcttctcttgagttatgacatatttttcaccttccattaatagtgagtctgttgaaataggaatttatac      162680
ttccttcttgtcctccatttccccaaaatccgttctctatccttacaattttatgctaataaatctcat      162750
taaggtatgaccagtcgatttctacattgccaaacccagtggcgtctttttagtgatgatcctatatcaat      162820
atgataggcacttatcacttgcagaattcttattcctttcattgtatcactatgctctggttttattct      162890
acaactctgagaagttcttttgtattttcttctcttactattcttaaatgttgactttttctcaaggtttg      162960
ttcttgacttcattctgtatattgtatgtctgggtaattcattgcatcttcttatcttccaactatctgc      163030
ctctatgtggatgattcttgagtctttattttcagcccaggccactagcttcattcagttacagtgtttg      163100
taattttagctcctgttagaaatctctagttgagtgtcacatatacacttcaaacacaacacattcaaat      163170
actgagaaatactcttcctctaaaacctattcctcactttgcaccctcctgttggctaaaggtgccccac      163240
atcccagagtgtccaagataaaaactgattttacttctctttctcaccacttatgtaaatagatatctg      163310
cctctcatcatttctgccctgcaaaacatccctagctatgtgcttctgcctgtggcccactgtgacagc      163380
ttccttctctcagtttagattgttatgcagtccattactcttctgcctcctaccatcaggctactattgg      163450
agtcatcttcctgattcttacattcgatgacttcaatggttaagtgatgcattgcaatctttcttatatg      163520
atttttctgctgctacaacagaatacctgaaactgttataaaaaatagaaatgtatttctaatagttccag      163590
aggctgacaagtccaacatcaaagcaccatcatctggctagtccttcttgcaccatcatctggcaagacc      163660
ttcttgcacaaaggcaaacaactcaagagagtgaacccactcctgcaaggtcttaaaaatgtatcatggc      163730
aaaatttcttgagtggccccctttttaccacctgagaaaacctaaaaccttgggacagcatagaagact      163800
ccttaatctgctcatgtctcccttttccagtgttagctccttttgcttctttgtataccttgtgccct      163870
tgcccattgaaacaaacagctcacagttccccgagcatacctgcctttctacctgcctgggagctgcctt      163940
ctaataggctgtatataggctgtatcttgatgacttcctctcaactctccctctggaaaggtcccagtca      164010
ttcatttgttaaggcccagtcgaaaatttatttcccttcacaaaatatttttaggtatacatatatgca      164080
tatgtatgctatctgtctattagatatatcttctttttggcctttattttttttattttttttattttttt      164150
gcaatagagtttcagtctgacacccaggctggagtgcagtgtcatgatcactgcaatcatgcagccttga      164220
cttcctgggctcaagcaatcctcccaccttagccttccgagtatctgggaatacaggtgcataccaccat      164290
gcccagctaattttttatatttttttgtgagacagagtcccattgtattacacagtaggtgtatcaaattt      164360
ctgggctcaagcaatcctcctgcatcatcctcctaaagtgctgggattacatgcctgtggccactgtgtc      164430
tggcattatccttgttaatttaatgcctacctcacttgtctttttcaaataatacttaatgaatgatttc      164500
tggattgatacatccatgaatgaaatgatagtttgccaaaatacagaatattagagccttggtgtcacct      164570
tgagattatttagatcagaaaaggggattttttttatattagaaggttattcactgtattatttttaaaaa      164640
gtttatttatctcaggtgtgttaattgttgagaatgtaacagaaaataagatatgaatggtctaagtgtt      164710
taggcattataataaagttgaagaaatgagaagaaatcccatggtgtttcttctcatgcattgataataa      164780
aacttctttattgattgcaactgtacaattggcagcaccgccccaaaactgaaaataagatcaaattctc      164850
ctttgttcttctttcatcaccttgcattttttatttttcttgggcttattgttatgagtttggtttctagct      164920
tttacagcataagaaagaagtggaaatcaagacggaaagaagttcatatagtgagaaggtgtcatgctgt      164990
gcaggccagtcatctcagagtctgactgcaacacccatgacataggccattcttttttcttgcccacgacc      165060
ctttccaaactaatatccaccagacttatattcctgtcctctttataaatgggggctgttgtctagcaggc      165130
tagcttaccggaaaaggactttctcagacgtgcttctcatcctgatggtttcctttaccagaagtgag      165200
gctgcaagcttcagcatgcgtttataacaaaaagagagattgacttttttcatttaaattccatgtttc      165270
tgcttggcatagtggcttatgcctgtaatcccagcacttttgggaggtcggggtgggagaatcgcttgaga      165340
acaggaggagttcatgaccagcctgggcaacataatgaaactactgtctctacaatatagtttttttctg      165410
agacaagatctcactctgttgcccagtatggagtccagtggcacaatctcagctcacttcagccttagcc      165480
tcccaggttccagtgatcctcttgcctcagcctctggagtatctgagaccacaggtgtgcaccaccatgc      165550
ccagatatatatttttttattttggtagagataattttttttatctttttgtaattgttgcatttttgcca      165620
tgttggccaggctggtcttgaactccagacctccaggttgctacctgtcttggcctctcaaaatgctgat      165690
attacagtgtaaaccactgcgtctggcctctgaaatttttttttccaattagtgtgcttgtagtctcagct      165760
acttaggatggtgagtcagaaggattgcttgagcctaggagtttgaggatacagtgagctgtaatcaccc      165830
caccctgggtgacataatgagatgctgtctctataaaaaaataaacaagttataaattttcacataatca      165900
taaacatgtgatgatgtggatacttcattttcacatttaggtctttaatacagtgataccttctcttttgg      165970
gcaacagtcatctctactctactgtgttgaaaagtttccacttttgccctttgaagattttgtgcttta      166040
ggaggaaacaattaaagggatgtccttcagcagaacagccaccctgtttaggaagaaactaattattgtg      166110
tgaaagggacagggtgatgttattgggtaatgatagtaagagataaaaccagttctcttgagctgttact      166180
tagattccataactgaggctgatttttgcatccttggcactagatgttattcagctgacagccatggattc      166250
ccaggggttccaagaaaccccccaaactatctgtcacctttatgagtaggtaagaatgtatttttcttgga      166320
gaggagtatctcctcaaagaagtctgtgatgtagaagaaaagatgaaaatctctgctttggattcggaa      166390
tgtcaggactactcactttgaacttaaggagaatttcttcttagtatgtacgagattaaaccatatgggg      166460
ttgccattttcttagacccatatagtcattttcatatggcttttatttggacaataagatcattgtgtag      166530
tccttttttcctttttcatctctcaaacttttttctcctcttgggcatattgttccaggtttcctttgtg      166600
gtttctagatcataagcattcatgcagtcacattacattccctcctaaattgtaagctctccaaagagag      166670
gggatatagctgctttatgttctcacccaactttgagtagggacaatagcaggaaacagaaagcatttc      166740
```

FIGURE 11A-33

| | |
|---|---|
| acagaaaggatggagtccatttgtgtgtcatatggatcttgtttgaaactttacctgtgtggcctggggtga | 166810 |
| attaatacagctgtctttaaaatctagaactgaaacctcagcggattgccataaggattcccagaagtta | 166880 |
| ggagctcctcagtaaatataagtatcctattctcttgtgtaatgaagctgacccacaggatgatgccaat | 166950 |
| tatatccttggtattataagcatatgaacaacagttcatatttattgaggcctcactatgtgtaagacac | 167020 |
| aattgtgtgctttgggatatttgctcatacatgaaacaaatgtttaaataaaacagcgtgccccacactg | 167090 |
| gagatgcagctgtcattagcattgacaccttcccagtatcatggtgccatgtctccatgtgggttaatc | 167160 |
| taaagataggctcaggcatattaaattgggaaggttgtcttaggataattcaagcaggattaagtcaata | 167230 |
| gtgaatgaagagctagattaaatggggagtttgggacatgcatctgctagatgaatttgagcaggaaa | 167300 |
| cataggcaagacttatctgctttagttttcacagtaggaccatgagattacactactgttttattaactct | 167370 |
| attacagagatgtggaaactgagattaggatgattgaataactcagccagattaggaatagggctggtag | 167440 |
| tctttaatgcaagtctcatggctatgctgcacatactcttaacaacttgctaccttcatggtaaaagcg | 167510 |
| aagaaccaacccaattccctttgccattccattcttgctatattagcctattttcacactttataaaga | 167580 |
| aatacctaagactgggtaatttacaaaggaagaaggtttaactgatttacagttccgcatggcttgggag | 167650 |
| gcctcaggaaacttacaatcatggcagaaggtgaaaggggaagaaaggcaccttcttcacaaggcagcagg | 167720 |
| aaggagagaagtgctgaggaaaggaggaagaaccccgtatacaaccatcagctctcatgagaactcactc | 167790 |
| actatcatgagaacattaggggggaactgcccccatgatctaaacaccccccacagggaccctcccccaa | 167860 |
| cacatggggattacaatttggattacaattctagatgacatttgggacaggacatagagccagaccacat | 167930 |
| cacctaccatttaattagcttactcaactatcctgcaaacattccttagggagcaaaagggacacactca | 168000 |
| taaatggttttaacgtattttaaaagttatcaatatgtagtttaatcataattttaaaatggtgcatc | 168070 |
| tcatgtcattggctaggatcagcagattacatgctgtatcttggggtcaataattgctgcaagcacttta | 168140 |
| ttggagttgctgttagtagtcatgctgtctactttgtcctttcttctcccatttcaaccaacctggcagg | 168210 |
| gattgacctcagtagtgagttgctagacatcaggagaagtcagaagtaagtggaagagggcctgctgtct | 168280 |
| agaagaacctccccccaccogcctggcccattgcagtgacaacacagatgcatgggagtaggttaaataa | 168350 |
| ttcttctctcttgatccattcattcatcttcatccatgaattaactattcatgactgactgattgttgttga | 168420 |
| ctctgagcataccacaacaaagaggatgcacaaactgtcctgctgttactttagttatggggacagaaga | 168490 |
| taaagcagtgatcaaatgcatgaaggacagaattttctgattgtgatcatagtttttgagggaaatgaagca | 168560 |
| gtgataacatctaacgtgggttatgaggatctctgagatggagtgtccagggcatgtctttttgagggtg | 168630 |
| aggaatttaagcatcccagacacaagttctgacccaaacattagcctttcattgtgagaaagggcctca | 168700 |
| ggaaatttaataaaatgtaatggtaggaattcacgataacactacaagaaaccaagctttgtttgtgaatg | 168770 |
| gtgggttagaagggtttgttgctagaaatccatttgcaggttctcaggctgggtttgaagtagaagc | 168840 |
| aacaatctcttgtcttttgccaagcaaagaacagtccctggtatctggcaaagagaagtatcttcctct | 168910 |
| gaatcctggtgttggccataagccaaagttctatatttaatttttcctttttggttgagttgggaagcagtt | 168980 |
| ggatgattagctaattttgctgaaatagaaggaaggcagattaaaaatatagaaaataactcctattta | 169050 |
| atgattaaaaaatgagattacagacaaagttgtaatgaaaggtgaaataattttgtttttatatataaaactg | 169120 |
| taaaatttaggctgggcatggtggctgacacctgtaatcacttgggaagctgaggtggggaggattgct | 169190 |
| ttagcccaggagttcaaggccagcctggtcaatataggaaactacatctctacaaaaattataaaatt | 169260 |
| agccaagcatcatggtatgtgcctatggtcccagctactagttagtctgtggcaagtagaattgcttgac | 169330 |
| cctgagagatcaagggtacagtgtactctgtcctggttgatagagtgagaccctgtcacacatacacaaa | 169400 |
| aaaactataaaattttcatatgtaataatattgaagctaaagtggaaatgtcataaaatatattttaat | 169470 |
| cctatggtataaatttctctctgttcattagttacaaaaatttgagcataaacactttcaaatacaaacc | 169540 |
| tgtgcaaatgtcatgatggcaggtggtatatcacttatatatttaagctgtatgtgggaataaaagga | 169610 |
| taaaaataaaagttaaatttaaaattctaatgaaggaacatattagaactacattatggaggactttgtt | 169680 |
| catttatggtctgagcacagatgatgctaaacatgggttgtcaacttcagttggcatccatttaaaatga | 169750 |
| acacactaaacaccttgagaagaaactgcatgaaaagtaaagagcattatccaagtgaacttcatatctc | 169820 |
| atcatttgcctgtcgtgtttatatattaataaaatacctacgtaattggtttaattaatcagtattttatttg | 169890 |
| gtgttgaaataatgagtggctgagcatgccagatgtattcatctgatacattcttccagtcacagggtag | 169960 |
| gctgcattaggtggtaatgctttacctgaattcatctgtaagttatgaagggaagtccataactctgat | 170030 |
| ctcagagcatttattccattgttgataagccaagctgttgctctcacttagttgttaaggaacaaggcta | 170100 |
| actggacctgatatgtaaagtatgtaaaatgtgtcctttcacgaaactctgaaacaaacaatgagaaca | 170170 |
| accagaaaaaatgctagagtcatacaaaagctgtctctatttttagtgatcattcctcaagctcttgt | 170240 |
| cagccactgagtgaccatagatggatttgcagttgttgccagtgtggctgattttgataggactaacata | 170310 |
| ggaccagtgtagggagctatttattaagatgttttttgttagtcagtgtttacatttgggtgttctctga | 170380 |
| taacatacattaattcctattgcagtatttaataaagtgtaactgtgcctgttccacatgtctaaacata | 170450 |
| ttcaaaatatgggactttgtttttggtctctattgcagatactaaatatcatattgtaattagagctatac | 170520 |
| agagatttagcatgtaagactgcaagtcttagaggctagctttgtgattcagtaagaaggtggtgatt | 170590 |
| ggagtgaacaaatcacgtgggggcacaattttgtgtttctggcttgagtgaccagtacttcctcttccct | 170660 |
| gcctcagtgcaatttcacattgtcttcatttgtgagatcacctgtgtcttagcccatttagttttgca | 170730 |
| attaaggaatctctgagactgggcaacatacagagaaaagaggtttatttggcttatggttctgcaggct | 170800 |
| gtacatcaatcatggcatcaggatctgcttcaagggtacagtctcagtgagggcatcagaaagcttgca | 170870 |
| ctcacggtggaaggtgaagaggagctggtgtatgcagagattacatgtcaagagaagaagcaagagaatg | 170940 |
| gggggaagtatgtgctaggctcttttaaacaatcagctttgggggggaatgaaaagagcaataattcaggt | 171010 |
| aattcagcaattacctcaaggagagcatcaaggtgctcatgaggcatccacctctgtgacccaaacacct | 171080 |
| accaaccaggcttcacctacaacattaggaatcaaatgtcaacctgacacttggagaggacaaacatcca | 171150 |
| aactctagcactctgtctccttaggtacactctttaatcttcagtgacttaccttcagtgactaagttctc | 171220 |
| tttggaaaatgcaaatgtagtcatgtttcttttttgcttgtaatgtcttactgatttcctgttctttata | 171290 |
| gcttcatgttgcatcttcatcagttggtgaaccagttgatgaagacaagatcagcatcctgaagtatctt | 171360 |
| ctacactttacttcaagattctcagaatgcatgttaactttactgcacagtgctgtttgccctggtctgg | 171430 |
| tgtatctctgttaaccccagtgcacttttctctgatcttcctaaggctcttaccttcttagttcctacgg | 171500 |
| cagtatttaataagtgtaactagtgcctgttccaccttgtcgttctgttctcaggactatcttgtgca | 171570 |
| atatgagtatgggctactgtggggcaagtacaatgcctggcatgcagcaagctctctattaatgattgttt | 171640 |
| ggctgctagagttctctttgctgttttcacatccattcttttgtcatcctcttttcccctagtcgtctttc | 171710 |
| cctgtaccttgcccttgttctccatgaatcaatataaatagtataagcttgtgcaaaacagaccttc | 171780 |
| acgcttgtcttatgtcttcattgctttcttctgcatactaaaaggccattacccttcctctctctgactct | 171850 |

FIGURE 11A-34

```
caatttcctaatctgtataattttgatagttatctccctgtctgctatttctgacgttggcgtgaacac      171920
gaatatgcgaagtaccagactttcactcctgtctcatgattgcattgccttcttctgcatactaaaggc      171990
cattaccttccctctatgagtctcaatttcctcatctgtatacttttgatagttgttttctactgtctgcc    172060
attgctgtgacaatggcacaactcagatatgcaaagtacctttgggctaaatgtgaacaaaaccttcaac     172130
ctgctgcatgataatctcacctttgcttgactggctagctctgttttcttggtagttggatgaagaacat    172200
gccaacaatgttatggacaatattgcttacaatatagatgatcccctattggtaaatagcatcatggcca    172270
ggaaaaaccataaagacttgaaagaacctagtgggaataccaccccacctcaggcttcctggagggcaag    172340
ttttggagtcacttgcagctgctatgttcactctagggacaatggaaactctgctcatggagtatttac    172410
agggaatattggctgctgtgaaggctgggacttcaatgccaaggaatacccaactcctgtggatatggac    172480
cttatagatctttgcatctcagctaaccttgtggagtagatggttcccacatgccagctgcagcctt      172550
cctgatgagctgagggtcttgtctatattgttttgagttggttggcaccatgttgactttgaggagtctt    172620
gttattctgcatgtttagtgtaacctaagaagatccttactgaatattaaagagcaaagacaagtgtccc    172690
tctaacagaatactggctaaacaattggtattctctctgatgcttcttacctgcttgaaagctcttttct    172760
ttcatccttcatagtcacttcttcatactcgacacatcaaccttcagctttgcattattccttcattatctttg 172830
tttgccccacatttcttaaaaacatagttttaaattgtgaccaaatgtacatgacatgacataaaatgtaccat    172900
ttttatatgtacagttgaggggtattaagtgcattcacatggttttgcaaatgtaccttttttggtcat    172970
cctgtgtccttattgtactctttcctggtttatgatgcagtgtcttatatatgatgtaataaatgtcccc    173040
tgggtatctcagccttgtatactctggtcttctgttatatcatgtacaccttgagggtagagattgtgcc    173110
ctactaatcttcctccttcatcacatgaaatattgtctctgcacagtaaatattcttcagtctcctttct     173180
gtcatgttttctgtataccatgacacttatttgccaaggatcactttgaccctctaggcaaaatttcac    173250
cattggtaacaatgctaaagttcacataaatcttaagttgaatctgaattttaaatatttgaatatgttt    173320
tgagtcccaaatttgtccaaagcatagccacagtgcccagctatttattttctgaattttttttggtag    173390
agattgggtcttgctatgttcccaaggctggtctggaactccttcaagcaacccctccctccttgac       173460
ctctcaaagtattaggatcacagatatgagccaccatacatggccaaagtttcatattattttagaaggt    173530
gatgagtgttctgaagtgaactagagaaggatacgtgttatcagagttgctgaggaagttgcagtacttt    173600
aagtagggtgatcagtgacaacatcaatgaaaacagaatgtggcagtcgagaatttaaagagttaaggga    173670
agaagccacgatgatatatgagaaggatgttccaggcagagggaagagccagtgccaaggcctgggtg     173740
ggaacatccctgttctctcttagcacagagcagtgtaattgtctgctctcatgctgccagtaaaggtatac    173810
ccaagactgtgtcacttataaaggagaggtttaatagtctcactgctctacatggctagggaagcctcac    173880
aatcatagtggaaggcaaggagaagcaaagtcatgtcttacatggatggcggcaggcaagagagagcatg    173950
tgcaggggaacttcctctataaaaccatcagatcttatgagacttactcactgtcatgagaacagtata    174020
ggaaatatccatccccatgattctgttacctcccattacttccttcccacaattatgggagctacaattc    174090
aatatgagatttgggtgggacacagccaaaccatatcaagcagtagatacctgttgccagaaaagagt     174160
gaatagtaggtatcagagtagagcaacactattgagatatttgtaattctgagaaccaggaagaacaaat    174230
ggaaagatttcacctgataaatcatgtgtcagagtgtgttttaaagcaggacttttgcttagctgaggctt    174300
acctgtcagggcaaggatgggatgagggaaaccagttagaatactgatgcaagagtcaagatgaaaacct    174370
acaactggaaactgaggagaagtggctcggttttttaacacatttgaaataaaatttgctcatgatttgg    174440
atgtggagtgtgggagatggaaggaagtccagagtttttggctgagacgtgagaaggtagaggtgatc     174510
acaggtgacattggaggatgagctggcagagatattcttcagacattattagatttgaatgtttgagttt    174580
gaaaagtctatgagacatcaaacataatatatcgcataaggacatgtatgacaaagtctgaagttcaaga    174650
gagaaatctgtgctgaagagaaaaaatatcagcctagatagtgtcgatggtatctaaagttatgagctg    174720
aatgaaattatcaagagagttctgtggacagagaaggcaaagggcaaaagaccaaggctggagtgactgg    174790
tagtcataggaggacctggaatggaaatgaaaataattgtatacagtgtaaaagaatatctggtaacatt    174860
gaagtcaatggttgaaaaaggcatttcagtgagacagaggtagtcaactaggtgtaattcaaataagtct    174930
caaatgagcatctattgctaagattccactacagaggcaaccaaaaagtgtcatcatgcttttgtctgt     175000
ctgattgtggcagctgagattgaatagaggtaggaagaggtgaaaaaagaatgaggaaaatagaagacat     175070
agcaatgcaaatgtcattgttgacctttactggaaaagtaataattttagtggagtttgggggtaaaagc    175140
acaattggagcagcttttcagagagaataaggtgccaatcaatatggatcaatatgtgataaatattttcaag  175210
gatatttttcagaaaaggaggcatatatattaaatataatattatatcatatataatatatatgataggag   175280
gtaactgaatcatggggatggagttttcccatgctgttcttgtgatagtaagtctcataagatattgtat    175350
tatatattatatattaatatcaattagttaatattaacattaatattatattatatataattatatataa   175420
tgtttgtgtatttcagatgagaaaattgttttatcgctttttaaggtgggaaatctaaccacatgtctgtg    175490
tgctgtaggggttgtaaagtttatttctcactcatgttcaaggttcactaagggttgactgtggctgtttc   175560
tgtgtcttcttaattctgggactcaggctgatatagaagactcatttcttattattattttttggcaaaggg   175630
caaaaatgtgcataaccgcattttttatctcttaaggtcctccacttgcaagtagcccttttaatttctgtt    175700
catctttcactagccaaagcaagtcaaatagctataactgaagttctaaactgagttagtgtaattcttt    175770
ccagttaggggcagggcaatattgaaagagttgtatttgtccctgtgagaggggggaggaaatttcttttatac    175840
aataatacaacatacaagaggaaagcaattctgatgatgtagcaagagaggagtatttttgttgttggatt    175910
gtggggagtcgatagaatttgaagagtaagagtcagctttagatatgatttatttcattcctctcttatg    175980
aaaagagggggcacagaagatgggaatgttattgtcacatgggtaaatgggttggtggtggtttgtgtat    176050
gttttcttcagattgttagaattttttcggtgtagtaagaagccaggtcatacgctaacagggaagacgg    176120
agcaggaaggattggggattagacgaggagaaggtgccaactatttagcagagcctttgagagaat       176190
tcatcagagaagtttattattccaggcatctccatgagcctactgagtttgtggtcctgagtttaaca     176260
tgagacaagtcagcatgattgaatatctttttcacctggctaattggcaaaggcgtagccactgcatgc    176330
tgggtggagaggtagatttcaccaggtttggtgttgtgccaaggaagagtcaaaaattaagactggatta    176400
gaactgaaggtgtctgaaggatggtggatctgatatgactccacaactctaagaaatgaagatccagtgc    176470
caccatcccatcatggaaatgacaaatgaatcaaacaaaatcatttatcacttttgtacaagattcggag    176540
ggcttgtgtgtctatgatctcaggcctcagaaagagtaaattgttattttttctcacataactcctgtg    176610
tgtgtgcattagtacaatttttatttttgccctagaatgtaaacataaatttgtcaaattaaagcagta    176680
aattggaaaaaaatatacagttttgtattatctgtagaaaaaatgttaccacagctatgtagactatga     176750
aaatggaaaatttattatgtatttaattttttacccaagagcagtaaaatgaagacacctatataattag    176820
gcaggtgactgttaaaatatttgattttttgttgaaattccttggctcagaaaacaggtttcatgccatg   176890
ctgaaaaattacttagtttgatgaaaaagtgaacaagacatgacagtgaaatcatataatgttcagacag    176960
```

FIGURE 11A-35

```
gaaatagcaaaagtctatttttttcaataactggctggagtaagttgtcctcatttttgggtcaagatctta         177030
ttttggtgtctcagctgaagataccctcttcacaacctattaggtattgtgacattgattaagtattatc         177100
aagcagaaagtatttgtaggaaattctttgtactgggtaggtaaggcaatcgctaccacaggggcataga         177170
ttttgaaacatttcaggaggatccaaagtcttactgagaaacctaaggcagtcagcaattagaggataag         177240
ataatggatgattaactactactgtgtgtggggtagacaattagagaacaatgcaacacacatgttttaa         177310
ggtgctgatcatgagtttgaacaatggtgaaaaatggaagaaaacatcactggcatgggctgacgctgtc         177380
aggggtggtgtgttttctcatgtgctgttatcctctcatcagtgttgagttggatagtattcccaggaat         177450
ggctgcttggcttcacttctcttaacagagaattgctctaccccataaatctgcagacacacctggatct         177520
tgaatttccatttttactctggaagatgtacagctgcaaacaaaatcaaatcacatttagcgcctttctgg         177590
aacttccccaagtactcagtagtcattctagctcacatcttaagtcccctagggttcaataagtatacta         177660
aatgcatatttgaaccatttccaaaatctaattcactttgatcaacagttgtttcctatgaatttgctgt         177730
gttttcttcaatatagaatactttctgtgattaatctttcagtagaccaaaggtgaggtagattacatta         177800
aattctaaatcatgaatgattcattcttttactgaaagtaaacacatctatcatattgactccatatcat         177870
attctgttgtatatcctcacttagatgtctttattatttttttagacagcttatatgattgtttagagctt         177940
caggcagtttacatagacaaaatatctgaataaaagtacaatgatcatatttttatttttgtcagtttaaaa         178010
tgatgtttaatgattttaatgccagagaaaacgtgtgtgtgcatgtatgtgcaaacatatttttaaagt         178080
aatggtttactgagaggattttttttctctttgtatgactaagatatctgaattctgccaaaagttgtt         178150
gaaatacgcccttcttaaaatgtcaatatgtctataacatattttttatgatatttcagtattagatatgt         178220
tcattacccccatgtactaattaggtcttatcttgtgatgatgagtcattagacctattatattgaaaata         178290
tttttaggtagaaatttatatagtctctgagtaaaatcttatgttgagtatgtgggtaagttgccttggg         178360
atcaccctgattgtatttttattgttgctgactttcatcattttattaatttgggaataaggacttcttt         178430
tttatggtgtagttctgtatcaccttccccttagattatattgtacaatgaacaggcagaagatactaaga         178500
tcttattaaaactagaactttgaacctaaatgggggatttatgaagctaaattagcctaattgcatattac         178570
aatgaccacagcatattaatcaaacatgtgacccttacatttgcaatttaatgatctttaatatgaaaag         178640
catttttgtaatataatctgcttgatgaacatttgctattttttactaatttttacttatctaattgttaat         178710
tcatgcaatttatctaattcttagtaatctatatgattcaagcctcttatagattttttatctctacccag         178780
ttttcatccagctgtctttctggttatctctgccttggtgtgcttgagtattatttctgattctgtgac         178850
tccaatgtactttgaagtgtctgaacttgaggtggcagaatcaaggtacttctatagaggccactgaatt         178920
ccttttctcatgatgaggtacaggaaccatttctcaaagctgccaaaacactgcccctagtctatgcaa         178990
atcagccagtacaaatgcatgtgactcaatcaacatcatgaaccacttttttgggaatgcctgatgttgac         179060
aaaatgtgatcttgtgacatcatttatttaagccaccttgtggtatcaaattggcaccattga         179130
caacatacttcttagacgctaagtgcaataattcgttgcctctcattttcctacactgctttacttcatt         179200
aaatctgcatcattaaaaatatttatagcattgctgaagtcacttcccaggagctaaggaatgtctccat         179270
ctgtatgctgatccagttcctgctggcatttgcttggatgcagaggccatccatctcttgccattgatat         179340
ttgtcaattgatgcttttttttcctctttttcctggtgacttaggaaaggttctgatgctatatctgctaca         179410
gatgccaccatggccagctaattttttaatttttgttttttgtagagacggagtattgctgtgtgttgcccag         179480
gatagtcatccactcctggcctcaagtgatcctcctggctagtcctcccaaagtgccaggattggaagtg         179550
tgagacacctctcccagcccagtgcttgatatttaagagcttcaggcatggaaagattttgtctgcctg         179620
ccacagccttccatcattttgggatgtatttgcttgagacagctgaatatgtgacaacctgaactgtggt         179690
tgctggcaattggaaaatagtagattgttctgttgatctgctgggagaagtacagcagcctgcagaggaa         179760
tagaagcccaggggttttatctggcacagaaattactctggacatgtaaaaaatttaatttctgttt         179830
ttataatttattgttattatttttagagacagggtcttgctctgtctctcagattggagtaggataatca         179900
tagctcactgcaaccttgaaatcctcaggttgagtgatcctcccacctcatcttctcaagtagttgggat         179970
gacaggcgtgcaccactataccctagctaatttctctatttttattttttgtagaaacagtatctctctctg         180040
ctgcccagtctgttcttgaactcttggcctcacgtaatcctcccatctagttctcctgaagtcctgggt         180110
tatgggtgtgatcgtgccatccattttggttgctgtttttaaatttgtacctttattgtcatgctaaata         180180
ggaattctgatgctactgttggctgaatagggtcaactggaacacacatttttgttttacaggtaaatac         180250
gatgaaacttaaaatgtagctaatgttattcctgaaacgaatatgtgaagttctaatttagggacaaaaa         180320
ttaaaaaaaaaaaaacatgttgcatgtattaaacaccttgttggctatgtttcatctgtaatttcattt         180390
ggaggtagccattgcttcttaactcatgctaaccgtgctttagagctattgatttttagcagctactatg         180460
ctttcatgcttgcagatcatttatctcttttggaaactcttttgatgacaaagctggctctgttacagag         180530
taatggtaaaagaaatgacttaccagaatttcaagtgaaatgtgcaacatacatgatgatgcatggtgac         180600
tgctataactatttcctaatgttgttatttaacagccatgaaagcatccaactgaaataggattgaatgg         180670
cttagttagctcaatgtttttgaaagctttctcagtaaagcatggtgccaggcaccaagtggttccttat         180740
agaggagccagagttaattttctgatgatgtttttaaaaacgctgctagaaattgggtggtgttttccaaatg         180810
atcttcctagtaattatttatgctatgaatcagaaagtttaccatctctctggatggaaatggatagtca         180880
tatgtgcacaaattcagggatttggcctcctatgataaagccctgtcttcccctcatttatgtgatgat         180950
tgtgcactatctgaatgatgagaaaccccattggccagttttcacttgtgcatggctggaggtgcttgctg         181020
cagctctgtgatgtcctgagccagcatgcttgtggagttccagtctgctgcatgaacaattgaagaaaca         181090
tgatcttcctaaattttttcacaagctgctaaatgagtgatttgtgtttcttttgaattcatgctgcaact         181160
ggaaatgcttgctcctccatgggttattgctcaatctacatgccatttgaggatgcagataattactgca         181230
tctttatggaagcatcccatcttagtccagatttcccttttcacagaccaaaaggtcaaagtcagacttg         181300
gcagacaacacagcttcagtctcatgggggatttctttgtcttatcaacctcagtcatgggcttccag         181370
ccattataatttcacatgtaatatggagggtattgttccaagaaagtgtggtgcctcagtaggggttgag         181440
gaggcacatgcagctgatatagctaaagaagagtgtgttaaaagtggaaggaggcaaattaaaagcacta         181510
aggaaagtttctttttacacaccacagaaagtttacaaaacatcgaggaagcttcagaccccaatccaggt         181580
actgcttttacttctgaactatgtcataatttgtgtatatcagaatattctatggaatctatggatacctg         181650
cagaaatagtttgctgttgttcccattctgcattatacatttataagcagttgctgtatcatgggataca         181720
taatgttctttaatcctaataggggcatcagttctaaatataaccaaaacaattgtgaaaggcacacatg         181790
cacaggttggcatatagagatggagatggccgatacgttgtgttttgtacagatgggaatgctttctgtg         181860
tcctgcccccaactgcaggacagctgacaggtagtccaaatgcccatgtagacagctggactccagaca         181930
gcttgctactgtctggcacgccttcaagtcctgactttcttgggtccctaatggaatttacattacc         182000
tgaaatttccgggagtttgtgaggctggctaaacagattccctaaataactggagatgtgcagtcagaga         182070
```

FIGURE 11A-36

```
gcgaatagacaaagaaggatgcggtggctgtcagtgtattcatttctttgctgcatatttgattactg      182140
caaatttagtggcttaaaatgacacactttgtcatctcacaattcttgtgggtcaggtttctgggcatg      182210
tctgaactggatttagtgctcagtgccacacggggatgaaatcaaggtgtcggctgggtagcatgattct    182280
ctgaaggttcatagtcctcttccaagctcactcaggaattggcagaattagtttattctgttgtaggat     182350
cgaagtcccctttcctttctctctgtcagcaggagctgatttcagctcatagaggtcccccaagcagctt    182420
gttgccatgcagccttctcagggaccatcttccaatatgttcatgcatgcatgcctgcatcttcatgtcc    182490
agcaggggaatctcttgctccagtctgctaagaaaaggaaaaatcttagataacataaccaaggcaatag    182560
catcgcattccatttcctaggtaacataacatactcacaggatgacttctaacaacttcataagtccagc    182630
tcatattcaccttcctgggattaaaggagggcatggcttatcgggtccttccaacttataaatactccaa    182700
tatataaatttcccaggggcttctataacatattaccacaaacagggtagcttaaaacaacagaaatgtat   182770
tccctccagttctggaggccagaaaaccaaaatccaggtgttgtcagggttggtttcttctgcaccttct    182840
gagggagaatctgttcctgcctctcctactttatgggggctgccagtaatttttggcttttcttggcagt    182910
gtcacttcaatactgtcttcatctttccaaggccttcttctctgcatatgtttctggatgctctcttctt    182980
ctaaagacacagtcattggatcgagggaccattgcaaatacatgatcattttatctctaaggagattaca    183050
tagtcacatctgcaaagaccctgcagtagtacctccttatccattgttttgttctccgtggtttcagttc    183120
ccggtgatcatttaatctcttggctaatcagttaactcttgagagattaagagttaatctcttactgag    183190
cataatttataaattaaactttattatgggcatgtatacataggagaaaacatagtatctatagaatttg    183260
gtactagctgcagcttcacatcttggagcctatcctcacgcataacaatctgggggtgttatgtatttcca   183330
aataggggtcacattctgagaatctggtagatgtgggttgtgcaacattattcaacacaatacaccctgt    183400
catgctttgcctgtgacctgacactgcccaattctctggtataatcttgcagcagactctcctttacctt    183470
ttctggaatatttccttacaactctctttctgactccttgactcccaattcagatcatctaaaactaaga    183540
gtaatatttagggattatcttgctgaccattagagaagatgggggtcactaacagatagatagataggtag   183610
gtaggcagatagatagatagatagatagatagatagatagatagatagattgatagataatagatgtgaa   183680
tcgatagatggaaatggatagtaagatgatagctaggtgatatatgtatatatagacagatagata        183750
gaaagatagatagatagatagatagatgatagagatggatagatatagatacatagatataatgatagctc   183820
ataatggatagatataggtagatagaggtggagagatataaagacagaaagtaagacatatagatatagat   183890
aagcagataggtgatagatagatagatagatagatagatagatagatagatagatagataaaggtagagatag 183960
aaacaggtagacaggtatatagatgatgggtatatagatgagagatagatagatagatagatagatagatag  184030
atagatagataggcaggcagcagacagagagacagatacataggcaggtaggtaggtagaggaca         184100
gagggatagataggtagacagagaaatagattgtagattggagagacggatagatagacatcttaattcc    184170
tgtgcgccaatccttctctctatagctaattataatcatacatgtatatggttacatttctattagtagc    184240
atttcacagtgggaattcagtgatttagtgattactgaattaattgttgtatgaggctccctgacagcaa    184310
acactgagtctttttgttcactatcctcagtgctatcattttacagtaaatggtggaggaaacgtaactt    184380
cctaccaaaagcattttgtggcgctgaaataggagaagtgagattctttactccatttccaaatcatg      184450
gatactggctccaacatcagaatttacatggtgcctaaagaattcatcctattgcattgaatacattcat    184520
gcacatgagtatttctgagcaattttggtttccaatgagatactcatctccagacagcactggacctta    184590
ctaagatgactaattattagttgacatgtgaatactatgtgctaggtgaatgtgtgaaaaatgtcattgg    184660
ctggaagggcttttctcaaattgtccaactttgcagccgtggactaataaccattttttcatgaaccaact  184730
ctgtctcttacatatttgtttaggttgggttaaagtttatttcaattgaacgtgtacatagagttgttgt   184800
atttaggagactttctgaaataattctcaggcaatcccttgaggtagaaaacatctccttgctttactg    184870
taaatccatttccatgctttttttctattcatagaggccacctgtattccttggcttatgactttagagac  184940
tgacacttgttgcctacaagtggctaaatgcaggaaggacagtacccctttgaacttaatttgtttccca   185010
ttggatctatggaaccattccctatgtgctaaggccataaaataatccctgagggagatggattactgttc  185080
agcttattgaaagagttagcataaatctacccagatctctccttagattttttggctgttctgggttggca 185150
atcatgttcacatctttttcctttctttttttttcattattttaaatttaagcatatttatgcagtagtt   185220
agcaatgtttgatacatataaggcatgctgatcagatcaaggtattcggcatatccatcatctcaaaca    185290
ttgatcatttatttgtatagaaacttccaatagcctcttctagccattggatacgatacatccttgtta    185360
actacagggttatagaatactagaacttattcttgatactctggctggaattttgtattctttcacaaatc  185430
tttctctatccctttcctttcttcctcccagcccctaatatctacgttctattctttcctcct         185500
atgagattaacgttttagatgagaaattcataacaggggatactacctaaatactatgttgggaagttac   185570
ctgttagaggactgggtcctctcttaagaagtgacttccagtatagtatctaggtagcatccctcagcc    185640
tgcagactccatgaggccaagaatgcttttagtgtgcccaacacaaatttgcaacctttcttaaaacat    185710
tgtgagttttttttgtgtgattttaaaaattagctcatcagcaattgttggtgtattttacgtgtggccc   185780
aagacaattcttcttcttccagtatgacctaaagaagccaaaaagattggacaccccggcagagggaggag  185850
gtttttatctaaatcatgaaaactggttggaatattggcagcagatgccgccatggcagggaattgggat   185920
ttcttgttaaaggtgttaccatttgagcatattgtaacattatttattactttcttatttactcttttc   185990
atgctgttaagtatttgggtgtgaattcagtaattcccatcccttcaattgaatgtagtagtaatagta    186060
ataacaataacaattctaaacctggagagattttataaatacctaaaattgcatgtaattatgaaagaaa   186130
tgaaatcattaagctaggaatcactcttttagtgaatctcaaataacatgcttttttttaatgataaaaaaa 186200
agctaattatttaaggtaaatctgtaaacacctagaggtacattaagcttacatgttggcccaaagtgat   186270
ggtttatgaatttgtgaaagagtgtaaaggattggcttagagtcattactgtatgggattaaatacttgcg  186340
ttcaacaaaatctcatcatataatcaccacacagtattattttctgaagaaacataatgctaatgcaaa    186410
cataaatggatattaaaatggagacaaattagaaatcatcaggatgtgttttaaaagctaggtagtatt    186480
ttttgattatagaattaggtaaaggctctgaatccttgagagcaacaacttgatacttaaaattatct     186550
gtattattaacaatggaggactgtgttcaaaacacaagatatcttaagaagaatttgcatcaagtttggc    186620
atcagaatcttgccaggtgaattggctgtattttaaagtaatattgtgatgtttatgggacccacctgc    186690
agtgaaataggtctcttcattccacacctggatacagcaatctctttgcattgctcttcttcttctctt    186760
ctgaaatgccatccttctttgtgaactacaattctaacacttagtccgtgcctctaaacaaagtgtc     186830
agttctgaattgccattatctctcgtcgaataacatgtttagttataattcttattttcttttactgca    186900
tcaaagatcttaagacataatcaatgatgtattcctctctctgtttatatttcattttgtgtgagtaaa    186970
acaaaacttccttgccagagattaacttaagaccgtgttctgactatttgtttaaaagatgatgttatgc   187040
catgaagtgtttgacttctaggtttgaacccaaaaccccaatagcttgatctcattgactaagttattt    187110
aaggattctgtgctgcagttgcctcatctataaagttaggacaaaaatactaccttaccactttttaagaa  187180
```

FIGURE 11A-37

```
ggctacaaagtatttggaatagtgccttgaatgcattaatcaaatactgcagttcaatacttaatattgt    187250
cattattaaatatctgttgccataggaagaccactggaataggagtaaaagggaaggtgcaaattttca    187320
ctccagcaccagtagcatgtattataaacacaatgatacagcatagtccttactatataaaaaccaggtg   187390
ggtcactaactagtgctagaatgttctagggaagtcattcttatttttctcttcttcaggctcttaaccta  187460
taaaatgcagataccaagtaaaaggaactagggcttcttggagaaatggctgatttgagaactggggcag   187530
gaaatataaaaggtaagcttgtagtgtgtgttgtagtgccagaaaggaggacaatgctaagcccgcatgc   187600
acacgcacacacacacacacacacacacacacacacacgcacaatgacatggtcatgacactgcatacaagg 187670
gccaacttagagagcattccatggccctctttgggacaactggagtaacaaaataaataacgtagttttg   187740
agttataactcaaagtgtagaatacatatccacaatccaatatttgatgtagatgactgaataaattagc   187810
atgatatagtaatttcctaatgctactatagaaaattacattatttttggcataaaaacagcacaaaggta  187880
tctcaccattttgttttgttagacatcttcattttaaaggttagaagtcccacatgggtctccctaggct   187950
gaaatcaaactgtccatagaattgattgcttttgagacctgttggggggaaattcatttccttgttttcca  188020
ttcatagaaggcacctgcatttcttggctcattcttttgcttgatgtgcaaagccagcagtgcagtgtc    188090
ttcagttgcttctctgactgcactcctgcttccttcttgttcttgaaggaactgttatgattatattggg   188160
gccacctggataattcacaataatcttatttttaaaatcaggcaatgcacaactttaattccatctgcgaa  188230
ctcataacatattggcagattgaggaaattaggatgtcgatatcctgggggaagtatcattatttttcctt  188300
accactggagagatgagaagaattctcatgaagaggcatttaaaataatttatataggtatttatccct    188370
taagaagttggagtataaatttttattattttatttatttatttattttttactctttgaattcattttt   188440
acattttggagatgaagtcactcaatattgcccagactgttctcaaactcctggcctctggcaatccttc   188510
tgcttcagcctcccagtgtttgggattataggtataaggcactgcacctggccataaatctcctttttt    188580
tattattatactttaagttttagggtacatgtgcaaacgtgcaggttagttacatatgtatacatttgtgc  188650
catgttggtgtgctgcacccattaactcttcatttaatgttaggtatatctcctaatgctattcctaccc   188720
cctaccccaccccacaacaggcccagtgtgtgatgttccccttcctgtgtccatgtgttctcattgtt     188790
cagttcccacctgtgagtgagaacatgtggtgtttggttttttgtccttgcgatagtttgctgagaatga   188860
tggtttccagcttcatccatgtccctacaaaggacatgaactcatcattgttggacatttgggttggttccaagtct 188930
atggtgtatatgtgccacattttcttaatccaggctatcattgttggacatttgggttggttccaagtct   189000
ttgctattgtgaataatgccgcaataaacgtacgtgtgcacgtgtctttatagcagcatgatttataatc   189070
ctttgggtatataccccagtaatgggattgctgggtcaattggtatttctagttctagatccctgagaaat  189140
cgccacactgacttccacaatggttgaactagtctacaatcccaccaacactgtaaaagtgttcctattt   189210
ctccacatcctctccagcacctgttgtttcctgacttttttaatgatcaccattctaactggtgtgagatg  189280
gtatctcattgtggttttgatttgcattgctctgatggctattgatgatgagcattttttcatgtgtctg   189350
ttggctgcataaatgtcttcttttgagaagtgtctgtccatatccttcgcccactttttgatgggttttt   189420
ttgttttctcttgtaaacttgttttaagttacttgtagattcggatatcagccctttgtcagatgggtcg   189490
attgcaaaaatttctccccattctgtaggttgcctgttcactctgatggtagtttgttttgctgtgcaga   189560
agctctttagtttaattagatcccatttgtcaattttggcttttgttgccattgctcttggtgtttaga    189630
catgaagtccttgcccatgcctatgtcctgaatgatattgcctaggttttcttctaggggttttttatggtt 189700
ttaggtctaacatttaagtcttaatccatcttgaattaattttttgtataaggtgtaaggaagggatcca   189770
gtttcagctttcacatacggctaaccagtttcccagcatcatttattaaatagggaatcctttccccat    189840
tgctggttttctcaggtttgacaaagatcagatggttgtagatatgcggcattatttctgagggctctg    189910
ttctgttccattaatctatatctctgtttggtaccagtaccgtactgttttggttactgtagccttgta    189980
gtatagtttgaagtcaggtagcgtgatgcctccagctttgttctttttggcttaggattgttttggcaatg  190050
caggctcttttttggttccatatgaactttaaagtagtttttttccaattctgtgaagaaagtcattgg    190120
tagcttgatggggatggcactgaatctataaattaccttgggcagtatggccattttcacaatattgatt   190190
cttcctacccatgagcatggaatgttcttccatttgtttgtatcctcttttatttcattgaggagtggtc   190260
tgtagttctccttgaagaggtccttcacatcccttgtaagttggattcctaggtatttattctctttga    190330
agcaattgtgaatgggagtcactcatgatttggctctctctgtctcttattggtattataagaatgcttgtg 190400
acttttgcacattgattttgtatcctgagactttgctgaagttgcctatcagcttaaagagattttcagc   190470
tgagacaatgggttttctaaagatacaatcatgtcatctgcaaacaaggacaatttgacttcctcttttt   190540
cctaattgaataccattatttccttcttctgcctgattgccctggccagaacttccaacactgtgttga    190610
attggagtggtgagagagggcaacccctgtcttgtgccagttttcaaagggaatgcttccagtttttgccc  190680
attctgtatatattggctgtaggttttgtcatagatagctcttattattttgatatacatcccatcaata   190750
cctgatttattgagagttttttagcattaaaggttgttgaagtttgtcaaaggcctttttctgcatttattg 190820
agataatcatatggttttttattgttggttctgtttatatgctggattacatttattgatttgcatatata  190890
gaaccaggcttgcatcccagggatgaagcccacttaatcatggtggataagcttttgatgtgctgctgg    190960
gtttggttttgccagtatttttattgaggatgtttgtcatcgtattgttcctcaggatattggtctaaaattct 191030
cttttttttgttgtgtctctgccaggctttggtagcaggatgatgctggcctcataaaacgagttaggga   191100
ggattccctcttttttctattgattggaatagtttcagaaggaatggtaccagctcctccttgtacctctg  191170
gtagaattcggctgtgaatccatcaggtcctggacttttttttggttggtaagctattaattattgcctga  191240
atttcagagcctgttattggtctgttcagagattcaacttcttcatggtttagacttgggcgggtgtatg   191310
tgtcgaggaatttatccattcttgtagattttctagtttgttttgtgtagaggtgtttatagtattctct   191380
gatggcagtttgtatttcttgggatcggtggtgatatccccttatcattttttattgcgtttatttgt     191450
ttcttctctcttttttaggtttaactgtgcatgatatcttccttccaaagagtgtacagtattgaaagg    191520
gtagacaaacggtatctttatagtggaggaacctgacaaacaataactcagacagatcagactcaatatc   191590
cacagcgataaactatttttactgtatgcattcttgataggctgtgagaagaaaggcattttctttttctcc 191660
cttcccaaaaattcataattagatctcagctcaatcacggtagacatgaaagacatcccagttgtgcaat   191730
actctataaaatgcctgacaaaaattcctcaaaaccatcaaggttatcagaagcaaggaaaacatgagaa   191800
acagttatagccaagaggcacctaagaagacaagatgactaaaatgtcacatgggattctagattgaatc   191870
ctggtacagaaaaaggacatgagctacaaactatgagaatctgaacaaaatgcaggctttactgaattat   191940
agtgtttccatcttggttcattaattataagaaatatgtcacactgatgtcaatgttattaatagggaa    192010
actgactgtcaggcatatggcagttctgtcttcactgtcttcacaatttctgcaaatctaaaactttccaa  192080
aattacaagttaatttaaaacaaatggacaaatggaaatgaaggtattataccttttttttctctaattct  192150
tggagaggctttgcagatgctactgtgtaatatccataaagttgccttgaaaatttcttaaattttaagt   192220
ttaaatgagatttttgcttaaaaaataaaacacgcacaatgtctagtcattttttgtttaataataatgcaag 192290
```

FIGURE 11A-38

```
tgattaccttggtgtcttcctgggtaagatctttctgtgataagtggttggagtcatagagtaaatagtc   192360
aacacactcttgttttcttgagtagcatgattatatggccaaataattgacatgcaaatcatagtgtcat   192430
cagggatacgtacaaatgttcatgcaacacagacttcttctaatgagtacggtattaaacagttcagtat   192500
agcattgagctgaggaacatgtcatagagattctggcacttgtacttggtgctcaaaggttttacaaagt   192570
tagagaggaaatttctggaggggaagcttagagacatcacattctctgaatcaaggaagagaatacttca   192640
tgagaaaaatctgagtggaagaaaaatgtttgagaaatcatgaaaaataccactgccagctatgatatga   192710
gctaacatttatggatcaccagttgtatgcaagaaaacatttacatgttaccagggaatcagaaggattg   192780
aaagagagtaataagcaatatttatgtgtatatatatattttttgtttgtttgcttgttttgttttgagatggaa   192850
tcttgttctgtcacccaggctagactgcagtgatgtaatcttggctcactgcaatttctgcctccctggt   192920
tcaagcagttcttctgccttggcctcctatgtcttgggattacaggcatgtggcatcacacctagcaaat   192990
tttcctgtttttagtagagatagggtttcaccaatatgattctttcaaagtgctcattacatcagaaagt   193060
ccctcgtgaaatagttcctcatagaaaggaaacagtctcgtgtttcttggccttagttcttttaggatg   193130
taatgaggataatatttgcttaccctaactacataggtatttcacaatctaggttgataatctcattta   193200
aaaaaaaatatatatatatatatatatatatatgtatgattgtgtgtagtgtgtatatatatacacttatat   193270
tgattgcgtgtgatgtgtatatatatacatatgtgtatgtgtatatatacacaatcagatatatgtgtat   193340
atgtatgcacatatatatacatacacacatatgtgtatatatatacacacatatatacatatacacatat   193410
gtgtatatatatatacctgttcaaagttattcggttttgaataacaacatttttgagaggtatcttagggca   193480
attaaaagtcaatttatgtgtatatatatatatatatatatatatatatatatctgtag   193550
cggtctatatatgcgtgtgtgtgtagaagttattaggttttttgtttgtttgtttcattgttgttttttga   193620
gatggagtctcgctctgtaatccaggctagtatagtgtcataaccttgcctctctgcaatatccgcca   193690
cctaggtgctagggattcttgagcctagtctcccaattagctgtgattacaggcatatgccaccatgcct   193760
gtataattttgtattttagtagagatagggtttcaccgtgttggccaggcaggccaacagatagatgt   193830
gtgtgtgtgcgcgtgtgagtaatacatataaacatctttgggttgtattagattttttaatacaacatttca   193900
agaaacatcttagggcaaataaatgtcaatttttcttttcaaatgacttttcttaataaaatgtatttaa   193970
aatacctagcaaaatataatattaagttagttctcatttttaaatacactgtgatttaatcacaagctca   194040
cagatccttagagatgatattgtctatcagctgaaaattcaaaaaaaatgggagatgctcatgtaaatat   194110
actaagatttgtatttcattcctgaaaacagaaacacttcagtggtaaaatttgcaacaaaaaaaaatgc   194180
ttatggaagcttagacaatgctctaggaotctaatagtaagcacaggaatatgtcaggaagccatacagt   194250
ctttagattcatttttgattcctacctgaaaaagtgtcaattcttgctaaatgtagcaaagcaacaaagaa   194320
aaattattattcacctgtttctctcagtgtttttcctaaccttaacccctatttcctaaccctatttaag   194390
ttatttcctaaccctttcctattccattattataataaagcattttttgatctggtagaaaattagaatt   194460
agaccttgcttttactgtcatcacaatagcatttttatcaagttttttttaaaaaaatagcaaatggcagaa   194530
ttattatatattgtatgttaatcgaaattattttttaccatgttatgaattataatttatatctcattctc   194600
aaaactaaagaagatgcaacattgcatttgcacacttgagaggagaattagttccacatgctacatagag   194670
agctgtatttatcattgttttttcacagctggtatgactgtgactattaaatagaggtgagcttgcaagc   194740
caaaaaatatgtgattcatccaacagttatttaccatgtaactatatgttctggatgtttaggtagttat   194810
tacaaattaggaaatatggtgttgaaaatcacaggaaacacctttgttttcttttttcctagccatttagc   194880
aaagagacctaattcaacaaggtatcatgttaaatattataattcatttggtgatgaaaaatgccaacta   194950
cagtgaataattgaggaactcaagttttatttaggaataatgctggatgaacagggaatgcctttctt   195020
aggaaatataattaggctgaccaataaaaatttgtcttacaggagaaaatgtgccttgcaagtaggggg   195090
aacagcagaattcccaaaagtcctaaaggcaacctgatgatgaaatgagttaagccatgttcacagtggt   195160
gtattagttgacttttgctacataaggaaccatctcaaagctaagcatctcaaacaacttttatttagca   195230
aagcatctcaaacaacctctatgtaggttatgattcttggttgggaatctgggctgtgctcatctgggag   195300
gctcttcagcctagagtcaactccaaggtcagttgggtgctcactggccaagcactatctcaacatggtg   195370
cttgtcagtgctcatgtggaatatcatcctctaacaggctagtgaggactcttcatgaaacttgtcaga   195440
gttgcatgtagatatgttcaagttctcttacagtgaaagctacatagtgtcagtgtcacctccctgatcc   195510
agaatgtccaaataagtaaatccgaaagatacaaatgaatgggcagtttccagggctgggggaaagag   195580
gaaatggagagtgaccactaactggtacagtatatttggggcatgggggaatcatgaaaacgttctgcca   195650
ttcgatattgtttattattgcacagatccatgaatacattaaaaaccactggattgcatactttgacata   195720
gtgatatgtatgatacagtaattatatctcagttaagctatttatcaacctatctctatctaatcaatct   195790
atcaaccaaataaattaagacagcctatgtatagagacaaatagaccaggagccagtcactgtggctcac   195860
acctgtaaacctagcactttgggaggccaaggtgggtgtatcacctaggtcctgagtttgagaacagcc   195930
tggccaatgcggtgaaacctcacctctattaaaaatacaaaaattagccgggaatggtggcgcaggcctg   196000
taatcccagatatttggggaagctgaggcagcagaatcacttgaatcgaaggcagagctttcagtgagc   196070
caaaactgcaccatttcactccagcctggtgacagacaagactccatcttaaaaaaaaaaaaagacaga   196140
acagaacagaggaaggtaggcagaaacagactctggtagatgtaaaacttggcatgtaagtgaagagcca   196210
taatacctatgtagctgaaaatggggagtgttatctaaggaaataattcaaataacctgtatactataccga   196280
cccagataaataaattccaaatgatttatgatccacatgacaaataaaactttgaactgttagaagaag   196350
agtaatcaaataaaatgtctttatgttttttggattacataaataatccttttttaaaaagcagacatta   196420
tggagaaaatagtgataaattataaataatatgcatcttaatgaattactttatataattaaaaatcaat   196490
aaaatagttaaaggcaacagaacagatatctccagtgctcaactgtgtaagcttgggcaaattatttaat   196560
ctccacatatctaattttcctcactgtgagatgatattagttacacatctcagaaggtagttatgaaaaa   196630
tatatattcagagctgggcatagtggctttcacctgtaatgcagcacctgggaggccgaggtggcagaa   196700
tcacttgaggccaagagttcaagactagcctgagaaaaatagtgagatcctctctccacaagaaattaaa   196770
aacaaaaattaactgggtgcagtggcacacacctgtaggggtcccagctactcgggaggctgaggttgga   196840
aggatcactggagcccaggagctggaagctgcagtgagctaaaaatgctcttcaccctgtgtgacagagt   196910
aagagttcatctctaaaaaacaaacaaatgaaatgcaaattcattatgcataaagcccttagaacagtat   196980
gcagcactgatttgcactgttaaatgtttgcctttacatcctcaaaagagaccatcatccatgaatgta   197050
aagatttcctgcaaaccaataacagatgttcagccaatcaaaaattggcttgctattcaagaagggaatt   197120
tagaatgatcaagacaacaaattacagaaatcgcactattttcaaggaacttgcaaattgaaat   197190
ataaactgtcaatatattatactcatcaaagtgacaaatatattgtctgataataacaagtgttgggaat   197260
aggataagggtgcagaattttcttacctgctagtgagtgtatagcataatacaacttgtttggaaagaa   197330
atacaccaggatatactgaagataaaattagtactaccctatgtatcagttagctactgctgcataacaa   197400
```

FIGURE 11A-39

```
agcactctaaaattcattcccttaaaacaataagcacttactactgcttatcagcctatgaatgttgtta        197470
attgtaaatttattttggtcttggctgtgctcattgatgtgtatttattgttgttttggggtgaactctc        197540
tcaggtagttggggatttgcgggaggtaattttgcctaggttggggccaatgggttcttcttatggcat        197610
ctattgtattccaatccactagtctgcattttcagagagcagtggtagagtttcaagagattaagaata        197680
tgtacaggggatttcagttctagtcttggaaatagcatatcattatattttttttctttgaaaaaaca        197750
caatcataaaccagtcaagattcaagggtgaaaatacagactttatctctatgtatgaggaatagcaaa        197820
ttcatgggacagattgtagaactggggacccctttgcctgtcaatcgactacaccctgtaattcaacat        197890
tatctatctagtagttatgtgccctagagctgaggtcttcaacctggcagaggccttttaaaactttt        197960
caaagtatgactcagctgattattttaaagaaaccaactttcaggtactcaacctccatatgttgtcttt       198030
tctaagccttcctggtcaccaaaatctcttcccatatcacaaaaggatgaccttcagtacacaagatgcg       198100
ttggtactgacctgccagggcttgtaataaaagaagtaaccatctgaatgctgctttctgggaagctact       198170
ttactgaaagctccataaattaagcctcccagggaggtgtggtggctcatgcctgtaatccaagcactct       198240
gggaggctgccagaggtggatcgcctgaggtttggagtttagagaccagcctggccaacatggcgagacc       198310
ccttctctactataaatacaaaaattaatttggcatgctggtgcattcctggaatcccagctactcggga       198380
agctgaggcaggagaatcacttggacccaggaagtggagcttgcagtgagccgaaatcactcactgcact       198450
ctagcctgggtgacaagagccgaactccatctaaaaaaaaaaaaaaaaagcctgccatcttatacgtatt       198520
tctattggtcctgtaccaatgttcttatttcagaacatgaaaaaagaaaagaagccataagttatctaag       198590
gcaattcttccaaatccagaaatcgaactttcctgtcaaaaaccagttttcaaagtgcacatacattgg        198660
gtgaagcccatcggtaaatgatccaatctgaaaatcttctgaaagtcatctttcaatttcttggtggtag       198730
tactattcaagtggaggttcagatagatttcaaaatgtctgcatggaatacctgctcttctcatctttcttgggct       198800
ttctctcagtgtatggaggaaagaggaagtatccagattgagtacctctgtcttctcatctttcttgggct       198870
actcttgtcccttctgtgccctccccttccaacctatgctttccctcagagcagcctgttttctttgctc       198940
ccataaatgtattactggtccttgctcttctgtgcatatttagcagcccctaaccctcttcctcaccagcc       199010
acccttctatccccagactggcctaccagaaacagcagagtatcctcaattcgtgcatgcattttcctgc       199080
cacgttggaatgatctgtatgcatgtctgtctctgatgttcatttccttttttcagcgtggctatgtattt       199150
acctcttttagccaggactgcattacctctctaagccagtcaaaaggttcaatacatacttatag        199220
aaggaatgggcttatgagcaaataaactcatgtgtcatggtcagtctgtgaagacagatcagtcacctcc       199290
tagctgcagagaactggggattgtaaattctcccccagttgcctttctgcgttggattacaagattaagc       199360
ctgtattcctctgtggccaagtgataaaataatcaatcacacccacatctatcatggccaagaaaacatt       199430
tattcctcacctctccccataggcaaattgcccgggaggagcaatatggaaaataatgtagttcacta       199500
aaaagcctctttctctacttaagataacagtatcaagtgaaaattaaccttgacctcttaaagaaag        199570
gaatatacagtaaaatatgaactactaaatacattttatataatatctcatgaagagcaataatgctaa        199640
ggttcttttggctatttccttatattcttgcttagataacaagatcacatttgtatctgatgactttct       199710
ctgatgatttagatatgtaagtggcaataaaattaatatatattataaacagatttaaattatttcctga       199780
tgcataatgttaacagcagtagatgtgatgctgaggttttccttttgatgttaatttgtcttttacaata       199850
gtcctcattttccacatttttaaattttctttttgttataaggtctagctgtgtcacccaggctggagtg       199920
taatcacacaatctcagttcactgcaatgaggttcaaatgattctcccatctcaatctcttgaatagctg       199990
ggactacaggatgtaccaccatgtctggctaattttttgtgaattttgtagagacgagctttccccatgt       200060
tggccagtcttgtctggaattactgagctccacctacctcaacttcccaaagtgttgggattaaggcatg       200130
agccaccatgtgcatatcattttccaaattatttacaaagtgtttctcttacattaataacataaagtac       200200
tattttagaaagactgactttgaaaataacatagataaagcactaaatgtgaacatcagaagaacaggtt       200270
aaaaaatgctggaatattcttcaggattagggaaattgagatttttttaataaaatgatatttaaatctt       200340
aataatagaatggctgtactttttgtttggagtatttaaatcttctcatttaaaaccagttctgcacagaa       200410
gttttacagagatgctaattgttgtatgaaatggaatattattctgacatttttgaggaagggtagacata       200480
gagaagagaaaggaaactcgcagtccacctaggttttattttgggcttctttgtgtgtgtgtgtgtccaag       200550
ccacaagctgggtttattcttgaataaacattagccaaattgtttttcctgaaccgtctattacctgcat       200620
gtacatagaccatggttgtgttcaaactagataatcaagatgacttgttttgttttagagacatttagtt        200690
agttgtaattacatggacaaataaagcagcagtttatcaaaaagaaagaaaggattaaaaaattatgca       200760
taggaaaggcagtatgtaattctgccttctgtttctggggtgaggctgtgctaaataagattaattta       200830
aaattgggatttggcaagtaatttctatcaaaatctcagcaggaggttttgttgcaactaacaagctgat       200900
gtggaaatttgcatgaaagtcaaaggacctagaacaagcaaaaagaccttggaataggggaagaagtt       200970
ggagggctttcatttaccatatgcagaaacctgaaaccggacccttcttacaccttacacaaaaatta       201040
actcaagatggattaaacacttaagacctaaaaccataaaaaccctagaagaaaacctaagcaataccat       201110
ttaggacataggcagcaaacgcttcatgactagaacaccaaaagcattggcaacaaaagccaaaaca       201180
gacaaatgggatcctattaaactaaagatcttctgcacacaaaagaaactagcatcagagtgaacaggc       201250
aatctacagaatggaagaaaagtttgcaacttatctaactgacaaaggactaataaccagaatctacaa       201320
agaacttaaacagatttacaagaaaaaacaagctcatcaaaaagtgggtgaagtatatgaacagacact       201390
tctcaaaagaagacatttatgcagccaacaagcatatgaaataaagctcatcatcagtggtcattacaga       201460
aatgcaaatcaaaaccataatgagataccatcttattaaaacctatgcacccatcccttatgcaccaga       201530
aaacaacagatgctggagaggatgtggagaaataggaatgcttttacactgttggtgggagtgtaaatta       201600
gttctaccattgtggaagacagtgtggcaattcctcaaggatctggaactagaaataccatttgacctag       201670
aaatcccattgggtatttacccaagtctctttgggtatatactcaaatgattataaattattgtactata       201740
aagacatgactatgtatgtttattgtagcactattcacaatagcaacaactcgtaagcaacccaaatgcc       201810
catcaatgataaactggataacaaaatgtggtacatatctaccgcggaatctatgcagccataaaaaag       201880
gacgtcctttgcaggcacatggatgaagttggaaaccatcattctcagcaaactaacacaagaacagaaa       201950
accaaacaccacatgttttcactcataagtgggagttgaacaggagaaaacatggacacagggagggaa       202020
agtcacacacccgggcctgtcatggagtggaagggtaggagacggatggcattaggagaaattcctaatg       202090
tagatgccgggctgatgagtgcaggaaaccacaatggcacatgtataccctatgtaacaaacctgcacgtt       202160
ctgcacatgcacctcagaactgaaagtataattttttttttaaataaaggtactataaagctatagtaatt       202230
gagatagtaggcaactcatttgggtataagtttggattaatgatatataattaattacagttggcccttg       202300
aacaacacaaggtttagaacccctgcacagtcgaatattcacttttaacttttttactccctcaatactta       202370
acaactaatagcctactgttgactggaatacttaccaataacataaacagctaattaacacatcttttgt       202440
atgttatatatacaatatgctgtattctccaaataaactaagttagagaaaagaaaatgatattaagaaa       202510
```

FIGURE 11A-40

```
atcataaataagagaaaatgcatttaccactcattaaatagaagtggatcttttgaaagtcctcatcct      202580
catcttcatatttagtaagctaaggaggaggaaggagagaagaggttggtcttctgtttcagggatggg      202650
tggtagagatggaagaaaaaggtagatctgcacagcacagttcagacctatgtgtagttcaacagtcaatta  202720
taaacagtttagaaatcaatccttcaatttatagtcaacaagttttttttaaatgctgcgaaaacaattaa   202790
aggaggcaaggatagtcttctcaataaatggcactgagacaattggttattcatatgtaaaaagatggat   202860
ttcaaccccttaacacttattatacccaaaaatttactcaaaatgaatgacagatgaaaatgtaagaatta  202930
aaattcttaaacttttaggaaacatcaacaacacaggacaatgtcttcagggccatggattgggaaagat   203000
ttcataaatgtgacttcaaaaatacagtagttcaaaagaattgatcagttgaacctcaaaaggacaatcct  203070
ttaatgaaaagtattgatcagtttaaagtcatcaaaatgaaaaacttttgcattttgaaagttatcactg   203140
agaaaaccaaaagacaagccataaactgggagaggagattggctaactatattcctgataaaagatttttt 203210
atctccaaaatgtgtaaaacaaaacaaaacactattcagtaataagacacaaattatttttaattggca    203280
aaaatatattattagacgtttcaccaaagagagtatacatgagaagatacttaatatcattagttattag   203350
acattagctacattaaaactacaatgaggtcaggtgtggtggctctatgcctgtaattccagcacattggg  203420
acgccaaaatgagtggattgtttgaggccaggagtttcacaccatcccggacaatagggaaagatcccat   203490
gtctaccaaaatacaaaaattaaccaggggccggcgggcgctgtggctcacgcctgtaatcccagcactt   203560
tgggaggccgaggcgggcggatcacgaggtcaggagatagagaccatcctggctaatacggtgaaacccc   203630
gtctctactaaaaatacaaaaaaattagccggtcatggtggagggcacctgtagtcccagctactctgga  203700
ggctgaggcaggagaatggcgtgaactcaggaggcggagctggcagtgagtagagatctcgccactgcac   203770
tccagactgggcgacagagcgagactccctatggaaaaaaaaattagccagaagtagtggtgaaggcct   203840
ggagtcccagctacttgagaggctgaggcacgagaattgcttaaacccatgaggtggatggaggttgtag  203910
tgagccgagatcacaccactgcccaccagtctggctaacaaagtgagactctatctcaaaaaataaaaac  203980
aaacaaacaaaaaaaccctacagtgagacacaattttacaccattagtatggctataacaacaacaaca   204050
aaaaagatattagcaagtgttgtctaggtaatagaaaaaatagagaccctttatatcaccattggtgaga  204120
atgccaactattacagctaatttgaaaataatcggccaatttcttaaaacaaaaacattaaacataaat   204190
ttgcccttatgaaacagcaatttcagccctagatatgtatgcaaagagatgaaaatatatgtccatgcaaa 204260
aaatggtacacaggtacacaaataattgttcatagcagcattattaataataatcaacaagtagaaatag  204330
accaaatgtcactaaaaaataaatggattttaaaagatgtggtataccccatacaatggaaaataatttagc 204400
cctaaaaaagtattgatgcatggtacaatatggacggacattgaaaatattatgtaaagtaaaagaagcc  204470
agacacaaaagactacatattatatgagttcatttatatgaaatgcctagaaaaagacaaatcttacaaa  204540
gacagaaagtggatcagcaaggctgtcactcccacgcactcagccaggtctgattttaaaggatattaag  204610
ccccattaaatggaaattaagttttgtttgatgtatggaaacagcaatatcaagtcttggtttcaaaata 204680
tgtttaacctcttttgagttatgtagaactggaaaatgttttcactcgcaagtattggacataacagta   204750
tttcccctctgccttaatccacttatcctagaacccataggaaggcaaagactgttttaattgagcgac   204820
acagtaaagttattgatagtggggtatgcacacatgggctacatctgtctatgaaaaggaaacaatgga   204890
gccaatttttaagtaattcaagcaaaattaaatgttcacacctttaatctggaagctataaaaagca     204960
aaatggtgctctgtacacaaagagcatagcctagttttttgctatcttaagcctcttcctgcattttgcc  205030
tatattaaatttcctatgcagatattattgaggtgatcaggtaggtgacttcaatttttatttttctataa 205100
caaattcaaattcaataactttcaagtaatatttaataactattttaaacacagaagcatagtctataa   205170
tattttgtcctgacttaaatactttattgcaagtagtagatgttaatacaagaaaacaatactgaataatg 205240
ggtagttgttcttttaaacatggagtagaggtaaatcttagtgatttagggacatttctaatttttagaga 205310
ttgtgcaatttaagtttctaatgcatgcaattaatgtcaattttctgatattttgattaaagtcctccc   205380
atgtttgctgtatgtgcttttgcttgccttatgaaaatttctaaccatagtgtatcagtaacatttcaaa  205450
aatgtatttaaattataatatgttcaaatcaagtactgtcaaatatgccatatgcatttcttttaagaa   205520
tgtgggaaatacctttaataattttattttctctttttttaaaactcacattagcatttttttgcagtag  205590
catcatttaaccccccaactgcatatccacagtatagctaatattttttacaagtaacattttgaatttg  205660
ttcttcttgacatcttttatgttttatatgtcattcctatctcatttttttgaaaccaaatgta        205730
accaatttcaagttttttgtgttacattcattttttttctttttactaggtagcatctttctcttttctgaa 205800
tttttttgcaaacatattgtttctgaattctctttcatccctttattttccttttcaatatcacccccagGA 205870
ACCAACATAAAGAGAAATGCAGACGATATAACCAGTAATGACCATGGTGAAGATAAAGgtattttttgtt   205940
ttttcaaagctcaaccctgatgcatgattttatgtctatctatctctctctttttttttattttcaacctgt  206010
ttttcctcccccttatttaactcttgtacacttttgtgtgcttcttttattttttcttcttgtatagaaaccac 206080
tgttatttttaaccccagttaccatgtactggaaacaaatcactgtgtgaagtataaacattgtttctgt  206150
acatgaaaatagtaatgaaatactacttacagagaagcccacctttttttttttttctttttttggctttg   206220
tcacaagaagaaaaaatagaatttaaagaatgcatgtatagtctcttttatccccttccaaatgttattt   206290
tgtaagttaatatactactttgcagcttccttcctaattagttttgcaaactgcaaaactttgcagc      206360
accttagaataattttttcataggactgaagtttcaattttgttcttttggtttggcattctttacaaac   206430
atattgattccaacatagtcatccaataatctgcttacagtgaagtacatcaaaaagcattttaacaaga   206500
tgctgttgttaacaagccctgattctttcagtactgccttttacaacatttaaagaaaaaaataagaagt  206570
agctcagaactgaaaaaggacaaaaagctagctatgtgcatctttgttttcacaccaccgttcttttgaaa 206640
atatgtttctcctttaaatgttttatgctgtgaagtttcttttttaaggtgacaaaatttgctcaatagat 206710
tatctaccagtagtggaaatatttttcataaaggtggaaggtctgagcagtcatgcagaaaacatagaca  206780
ctatttttatccccttttgtgtagaagaaatttgttttttgttttttgttcttgttttttttaaaagaggagaa 206850
acaacaagaaagtactcaagccattcctcattggtaaggctctatatgattagctaactgcacattttttt 206920
cccatctgggtagcaaaatgtatggaaattctatttattttttcataaacaataaggccctggctggaccttt 206990
tgggtctctgtctgaaaggccaagcccaaaagtgagtgttgcattatccttgctggtcaagccccattt   207060
cttgaaagtgtcttttgaccagttcttgtagttgctcccctcctttgcttatcttcataaatcaactgttc  207130
tccaagaaaagaagtcttgccaacactcttttcatgcctggtcttcccttaacattttgattattactga  207200
gcacatagggttgtcactgcctcaagtagctctctaagaggtcttgattctgatggtggtagaagttcag  207270
gtacctcttctttgataagggcttctaaatgcctcacattttgtcagtattgagcaaatacataaaaatg  207340
aaataaactttttgttctctcataccttatactgtctaatttgtatcctctttggtgtcctctcacatac   207410
ttccttttgataattaagatctgttttcacattattcccagtgaatgtttattaccatgaaaatgccatc  207480
taatttctcttaatattaataagctgtgatttttgaatttgctttaatgtaacaactggtatcactcc    207550
acaagttcaagagaatcttgttgtatgttttatgaaaggtaagaaatgttaatttcccatattttcaaag  207620
```

FIGURE 11A-41

```
ggagcactttaaagcagcccttcaaaatctctacttactcttttaccacaatttactagccaacagctg         207690
gtagtggtaaaagaaatgaagccaaaaacaggaaattaggaaccgggaagaagaagtggaacatgagaaa        207760
agccatttcttattcatatagcagaggacatttcccatagagtatgatgaataagtgatgaatgaagatt        207830
tttactttatatttgaattttatatgagaaaataaaagcactttttctgccgtggattaaatatctgcaa        207900
ataaatactcgggtaacttgacattcttttgtgtgctttactgtgaccattgggtatgtcatgtcatctg        207970
tatgcaccctgtaaaattgtgatcataattcattcaaattggagccaccatccaaacgatggtaattcat        208040
atcctcagaattcctttctcatatttcaagtgtccctgtgaattatgaggggaaaaaaatcttttattaaa      208110
gaaaaaagtgaaaataaatatgcatggatacttggatttttcttttagtaacaaagatatttaaattatt       208180
tgtatacacacacacacacacacacacacacacacacacgtatctgtacctagaaatgtttataggggag       208250
gtcagttttctgaagattaaatgcagccctaatgtcagattaatgttataaacacatcgtttaatcacaa       208320
gttttcagagagcaggctccacagatagtctctaactttctatcattacaaatcgctatttttatatcat       208390
tgctaatttaaataataaagtaaattatgaagaggaatcattggttgcaagtcaccatgggagtttagtc       208460
cctgtgaaaatataaagcatttaaataatttgtattcttttaccattttttattacatctcttttaattttt    208530
tgtcacttgaatatattaggatgatgatgatactataatcactggaacaaagacatttgcttggacatct      208600
tttcttttttcccccattttttgttctgttaataatttttaactatagctttccttttctgtccttatct       208670
gtccctatcgatcatagatagtttcactactattttttaagttttttattgttaaattgaagatgaatctg     208740
tacagttacttgtgaattaagatgcagctaagttaaaatcaagtataattttgaagctgattttacatttt     208810
aactagatgattaaatatattttttcaggtgcttcttcaatttaaatcaagttttatggtttcagcaaaa      208880
tttagaaaatatgtactttacctaaaaacttttcttttagtgctttggatatatacagaagcttaaatga      208950
gtagagtatcccaaacatccagatgcttctcaaaatagcatttccggccgggcgcggtggctcacgcctg      209020
taatcccagcactttgggaggccgaggcgggcggatcacgaggtcaggagatcgagaccatcccggctaa      209090
aacggtgaaaccccgtctctactaaaaatacaaaaaattagccgggcgtagtggcgggcgcctgtagtcc      209160
cagctacttgggaggctgaggcaggagaatagcgtgaacccgggaggcggagcttgcagtgagccgagat      209230
cccgccactgcactccagcctgggcgacagagcgagactccgtctcaaaaaaaaaaaaaaaaaaaaaaaa      209300
aaaaaaaaaaaaaaaaaaatagcatttccagaaacagaaaatgtaatagcattagtcaagttacttag       209370
aaactcttatcaagtgtcatatcatccataaaaattaatttgcttacttcaagtcaaaataaggaaatca     209440
gggaatctcctttgttcttaatttagcatcagtgagtgagccagtaagattctttactgcgtttccttac     209510
ttggctttttttccagATATTCATGAACAGAACAGTAAGAAGCCTGTTATGGTCTATATCCATGGGGAT      209580
CTTACATGGAGGGAACCGGTAACATGATTGATGGCAGCATTTTGGCCAGCTATGGGAACGTCATCGTTAT       209650
CACCATTAACTACCGTCTGGGAATACTAGgtaagtgatttcatcatgtgaatgactaagcaagaggaaac       209720
atgaaagttccacttcttattttgatgggactcatggatttgaatcccgttattacagttcctggttaat       209790
tccactttacggtatttactttatgttatcaggtatgttttttccttttattaccttcatgcaacatgac      209860
catcttattgttttattatcattcttttccttttcgcttctgatccaaaattttttttcttgtggaagttg    209930
aatcccttctcaaacaaatggccacttcaagttcatcaggattaaatgaaattttatttaaagcatgttt     210000
cttcattggaattaaatgaatgtgtatttatctacataagtgtgtataatgagcacatatttggtgatat     210070
gataattagtaatggccatagatcttagctttctagtctgattgtgttactatatgaattagtatattgt    210140
atggaggaaaagatttatccagttccctaactgattatgttgaggctttggaagatctgctgtttaggt      210210
tctgttagttgacttttttttttcatttgataatctacaattaaaggccaagtacatggaaattcaagtt     210280
tagctcctccttgtttagatgtttcattcattgtcttctaattgtgggttggaaaattaagttacaactt     210350
cagggtaaaggttttaataccttcttagatgacctttcctgcttttggttttagttcgtgaataataatcct    210420
agatctctgtaaaaacatttgttttttttgggtaaaaatccattaaaatgatgtagaaaataaaattttaa    210490
caaattattcaattcactacatgtaggttagcttgaatgaagttatatttgttgcatgcatttgatcttg     210560
aattgaaacctacagtttaagaaaatctgcatgtctttatatttttaacagactgtcagagttataaaag     210630
caaaacattagagctttacagtataatattttttcttagatctttcatgggcatttaaaatcactcatt      210700
atgaagagaccataaaccatgggtttctaagaggtgtgctgaattttgcaactggctggtgtgttttcta     210770
aataatcctgtaatcttcatgtattagtttttttttttcataacaaatcatgacaaatgttctctttaaa     210840
caagaggaatttactttctcataatttgggaaaccagatgttcaaaacaaggtgttggcagggctgtct      210910
ttccctaggtagctccagaacaagattctttcttgccttttcagcttctggtggccctggtgtttgtttc     210980
tatcttcacaacactgtcttccctgtattttatgtgtcatctccttttcttttcctttcttttcttttct    211050
ctttttttggggaggtagggggacagaatctctgtcacccagctggagtgcagtgacatgatcttgg       211120
ctcactgcaacctctgcctcccaggttcaagcaattctctggcctcagccttctaagtagctgggattac     211190
aggcacccacgaccatgcccagctaactttttatatttttttagtagtcatggggtttcaccatggtggcc    211260
aggctggtttcgaattcctgacctcaggtaatccaccctgtcggccacccaaagtactaggattacagg      211330
tgttggcgaccttgccaggcctcctttccttgtaaggataccagtcattggatttagggtttatcctaaa     211400
ttcaggataattatatctgaagaccccttaactaattacatctgcaaagaccctgtcttcaaatagatcac    211470
attcatagtttccaggtagaaatatatttttggaggatattgctcaaccccactccacccaatcgatgatt    211540
attgcaatatgtatgtgtgaatataggtgctttcagatgcttccattccatatgtgtgcacaaccactgt     211610
gttcagaattccaccttgctttctacttactaggccacactctggtaagatgatctgaggacagtctgga     211680
attcttcttccctttgtattcaaataatatagtcatgcagtatctaaaagtttattccctgagcctttaa     211750
aacttctccatcagtttgacaaggagtaaaagtgtttttcccccatttgtcacaaaacttgtgcaaaaagc    211820
acctttcccatgggccaatacacagagctatatttcacattttcttcttaaattacagggttataaatat     211890
aaaacaaaacctttaccttgctgtattattccaacttttccctctattattaattccgattacaaatgc      211960
tcattaatgttctacctggaattgcaatttgggcatgtgccatctgaaatggaggttcctaaaaatta       212030
atatcaaagattaatgcaagttttaaaaaagggacttattcaaacataactcccattttaacgtgactcg     212100
tggactttaatgaaatgaatggccttgtaatcattacatctgcaaagaccctgtctgtcatagcc           212170
ttctctttagaacatatctgatttgccagaacccaagatttgtgagatggtgttatttttatttttact      212240
.ctttcccacccatagtaccatgaagagattatgtaacatcctttctggttttaaagacaggtgaata       212310
atgattatgtaacatgcaaacaagttgggtgttttagagaaggtggtgttaatggtgtctgattcacaga     212380
tgctggcttgaaccttactggtgttaggacctatattctggtaagatccaactttaggccatggattaca     212450
ggacctaggtgtataaaaacgataccttaaaacccataagatcttagttcactgatcagcaggagagtag     212520
ttttcttttcaaatgataccatcagatgcatctccagcagactgttaagtcagtgaaaagaaaaatgccat    212590
catagagaagttcttcagacttttaaaaattcctaggattatgccagtgattcctactacagagacaaa     212660
gatatatgtatttctgaatttgagatgttggatattggtagagattcatcttttgaatgcaaataaatat    212730
```

FIGURE 11A-42

```
gctttacttttagccagcatgaatgctctcatttgccacaggttggccagcttaagtatgaagggtgttg      212800
tgggtaaccttaacagaaggttttttatagtaccaaaatttcttcttttttattatcctatttcagaaa      212870
gtttcttaactctgagatactttatattggggataatagttctggtgcaagtatagattaatagattatt      212940
aaacacttcaacatatagatggaagagtacaaatagtatattattactgattcccatttactctttcttt      213010
aatttacactggaattttgttttatgctaacttttgaagataccaatgataggaagttaatagtgcttgc      213080
ctttttataattttttccagagcttattcatttgaagttcaaatttggaaactttccttttgttctttgga      213150
aacagatattattgctattcaaaatgggtaatctctaaattgatatagaaaaagatatttgaggctggat      213220
gcagtggctcatatctgttatcttagcacattggaaagctaaggcaggaggacaacttgaagccaggagt      213290
ttgagaccagcctagacaatatgacaaaactccatctctgctaagaatacaaaaattagctgggcatggt      213360
gtcacacacctgtaatcccagctacctgggaggctgagatgcacgaatcagtggagcctgggagttggag      213430
tgtgcagtgaccacctcactccaccctgggctacagagcaagactgtgtttccaaaaaaagaaaagaaag      213500
aaagaaagaaaagaaatttgagatattagtattgtccaaaaagtataattcaaatacttaatgca      213570
gaaggtagtagcatcattaacttactgacccattcatcaattataacagagggaaggttctatgttagtg      213640
tcttggaggctgattgagctaggggatacaatttaagtatgagtttcatagaacagattcaggaggtct      213710
aaatagaggggtctacaattaggaagcacccttaatcccacccctgaattactgacagcaacactaacta      213780
ggcagcagagagatatttcctgatctcagcagtcaagacattgtactaaaggttgctagataaatgtga      213850
tttttgtagtcactcacctgcaagttataggcaagataatatttacctgcactcccaccagaaattagac      213920
ctaattgactgctcttaatcagaacaagacattccaacctcttattcatggttagcaatatatcccactt      213990
gcttcactttgtgattcatcattgcatgggtataactggacatgaatgcatttgaaactgagcctcaag      214060
ttcaaatcaccatagaacctaaaaagaaaatgtaggagagacaaaacagaagaaaaatgccaaacagaga      214130
gttattatttagatgtgttcattctgtgaacagagacagttctattggatctggctgaaatagggggcc      214200
cctggtgtcgtgaaagtggtgtatgtcttcatacatgttcccatgggcctatacaaccaatctcatttga      214270
caaatgaagaaatgaaggcttgtggtcagggtcacaaaacttgacagtggcagaagtggatccaatttcc      214340
agtcaaatctatgactcaatccatcttcgccacaatcatagtgcaaatcagttgctctgtttccgatcag      214410
taccccacaccagaaggtcagctctcttaagggcatgaattgttgttgtttggttcatgttgagtgttt      214480
ggagcttggaccagtacatcgaaagtcttaattgttgacattctcagtaatgcaaaatcaaattgtattct      214550
tggatcattggcatcatatccattaggatggctgttaataaagtaaatgtaaaataagaagttgtgatgg      214620
agatgtggaggaactggaactctttcacattgctggtgggaatgtaaaatggtacagtcattgtggaaaa      214690
ctctttgtctgttcctcaaaaaagtaaacatggaactaccatatgtgatccaacaattctacctccgggt      214760
atatactcaaaagagttgaaagcaggtattccaagagatatttgtatgcccaaattctgtgcccatgtttt      214830
ctcaatagctaacaggtgaacttttgaaatagccactgcccagtgatggatgaatggataaaaattgatg      214900
tatatgtatatatgtatgtgtgtgtgcacaaatacaaacacatacactactgaaatggaatgttattcat      214970
ctgtaaaaggaaggaaattctgatacatgctacaatataaataaaccttgaatacatcattctaagaga      215040
aataagctataagctagtcacaaaaggacaaatgctgtatatttttaccaatatgggttccacctagag      215110
ttgtcaaattcatagagacaaaaagttgtatggtgtttgtgtggggctgggagacaaaatggaaaattat      215180
tttctaatggatagaatttcaattttgaaaggtataaaatcatttggagatggatggtggggacagttgg      215250
acaataatgtgactattcttaaggccactcaattatacaccaaaaaatagctaaaatgataaaatttcat      215320
attatctatattgtatcacaacaaaagaaatcattatgatatctgtgatttaattgactcattgtaatca      215390
ttaccatgttaggtcatgttcagtatctcatatccagcaatattgcaatggacatggtaattttttgagtg      215460
gtagaaactcacgtaacttttaaaaacacatctgtgtgtattcacatattcttatattttcttggaattga      215530
aatcatactctctatatctcatttatttctcgtagcaaaatgtttacaaggttttcaagattcatccaca      215600
ttgtagcatgtatcagtcagtaccgcatactggtttatggctggatactgttccatttatgatagacca      215670
cattctattatatatctgtttttcatttgatggacatttgggttcaattcatacagaaagaaagtagact      215740
agtggttactggttctgggatgagaaccatagggaattagcatgtcatggttacagagttttccatttgtg      215810
aagaagaaagagttctagagatagattcataaaaatgtgaattactgaatggcgtcaaacagaacagtac      215880
acttaaaatggttcacattatgttatgtgaatttcatcttaaatagaagaagaatacagtctgaagttg      215950
tcatgtacttcactaggatgatctctttaaagggtaggaaagaaattagtgttcatccatgtcctcaaa      216020
agagcatataaacaaactaaacaaccatcaaataaaacatgtcaatgtacctcacagcatcccaaaggg      216090
aagactaaactaaactgttctcagggctccttcttccttatgtgttactttcagaggcactttagcttag      216160
gacttaatttgactattcacaaccccagggtgtccatttgatctcacagcaaactttgagttgactttgac      216230
cagggaaacacttttactttaagaaactgtagaaaggagaaaattttatacgtatccagtttctatccatt      216300
tcattgcacatatggtgagaacttaagtgttgtaagcatgccacttgcagggccctgggctcacagctac      216370
aagctatattttgtatttgcatccactgtttttgttagcagatgtatatacttgctgacaaaatacatgtt      216440
ttaagaaataaaattattttaagaacaaaataataatatgttttaagaaaacatgcttgtattttaccctt      216510
tattttttcataaaaaaaatgtttatgggcagggcacggtggcttatgcctgtaatcccagcacttggta      216580
agccctaggcaggtggatcaggatgtcaagagtttgagaccagcctggccaatatggtaaaacccatgt      216650
ctactaaaattacaaaaattagccaagcatggtggcgcacacctgtagtcgcagatacttgggaggctga      216720
ggcaggagaatcacttgaagccagaaggcaaaggttgcagtgagccaagatcacgctactacactctgac      216790
ctaggtgtcagaataagactccatctaaaaaaaaagtttatgaatttatggatgttagaaactcagttt      216860
gttacatgggtttattcatagtggtgatctctgggcttatattgcacccgtcacctgaatagtggaacct      216930
gtatccagtaggtattatttcatcattcattctccttccatgtcctcatatttgtagcctccagtgtct      217000
attccactctgtattccactattccactctgtatgttaatgtgtacctgttgtttagctcccacttataa      217070
gtgagaatatgcagtattgaactttctgagttatttcactcatgatactgagttccaccagttcaccc      217140
atgtccctgcaaaacacataatttcattctttttatgactgactactgagttgtattccatggatatat      217210
aaactacggtatatataatttatgtatccagttatctagtcatttgttatggacacttaagttgatttca      217280
tgacttactattgtgaatagtgcagtgataaacatatcagtacaggtctcttttaatagaacaatttc      217350
ttttcctttgggcagaaacccactactgggattgctgaaccaaattatgtgtgtgtgtgtgtgtgtgt      217420
gtgtgtgtgtgtgtgtgtatagttcttgttttttttgagacagagtctgactctgtcaccagg      217490
ctggagtcagtggcatgatattgactcagtataaatttcatctcccaggttcaagtgattcttctgcct      217560
cagcctcctgagtagctgggattacagacctgcaccaccaccccagataatttttgtatttttagtagg      217630
aacagggtttcaccatgttggccaggattgtctcgatctcttgaccttgtgatctgcttgccttggcctc      217700
ccaaagtgctgggattacaggcgtgagccactacgcctggccccaaatggtagttctatcttaagttatt      217770
tggaaaatctccatactgcattccatagaggttgtattaatttaccttctcaccaacagtgtataactgt      217840
```

FIGURE 11A-43

```
accctttttctcaccattcttgccaacgtatgttgcttttttgacgtttttcaaaatgtcattcatttccac       217910
attttattataattccttaaaattatgacttttaacaaagagaagggaaacatacagttggtaatttttt         217980
taagtgctgtataatttctagttagaaagccacagataagcccgtgctgaagcgaggtggtaaaatagc          218050
acaagtttgaaataaagtaaatttgggaagataaagttgttttttaggatgataaagatgttagatgttta       218120
aacttggtccaattttttctaacttttactgtattcttcacacttacccaaaccacaaacaacaaaagtga      218190
gataaggcagtgattggggatcctgttccaatgcagataccagagattctcttactggaatgatgaatgg        218260
ttaacagctatgctgcatgtggaagtaaaatgcttttccccccccaaaaaaaatggaccaataaacacatag      218330
cttgggcctttaaggtcatatcaaccaatggttgacccaaagtctgtccaggtgtgttgacagacttcag        218400
tcttttcttcctgtgatatgagttcaggtagtagaaactcagggaagggcccttttgctttcttttttgatg     218470
ggtccagactttagcagataagcaacattagagaaaaacttcctcctgtgctttggggtcacagagggtt        218540
gaaagacaagagggagtgagagaagatgagagacattgaggcttcttcttcagttcaacacatcaaagca        218610
ccatatgttggagcatggatttctgagtcccaacaactgggtagtgaagaccacccagggctgtgtgttg        218680
aggattctgatgcagacagtcaaggctcacttctctgagaggaagctaaatgcgactcaggaacacatcc        218750
ccatctcaaatgtgtttgttatattgatgacagttggcactcagatagcatgcatcccttgtggtttcaa       218820
cggttggttgacatgaccttaaaggccaaagctatgtattcattggtccattttttttgaggaatgcattt     218890
tatttccacaatgcagcaaagctgctaaccattcatcatgccagtaagagaatcccgggatctgcactg        218960
gaacaggatccccaatcactgctttatctcacttttgttgtttgttttgttttaatttgttttatgttttt    219030
acaaataatctgaagttaaaatataattgataaaagcagttatctgtgatgtcaggataagtaaactag        219100
tgcacttcaagcaacatctaaccaagtgtcattttcttgctggattgcaatattgataggcacatgggat       219170
aatatatcacgtagatcctgattgtagatcaatgcatcttgatcctgcatcttgaccctcttctcagtgg       219240
gctacatttatgcctaaagaaaaatattctctcaatcctcaagaacatgaaacattacaatctgcagagc       219310
aaattgccagcaggagaaaatgttaccaaatattcaaaagcatgctttttgtgtaaatgatcttgaaact       219380
ccaggtaatgggggaaacagggtgaggagtgcataagccaagaacctatttgacccagcagcttccggt        219450
ttctaaaacccctactcatgcagtgccaggaggaaaataaccaattggcatcacttaatgtttagtgatag      219520
aaaaagaaaagcatgccttgttcattttctactcttcctgcctcaccattcatcaaatgaaa              219590
cagtacattttcatttttctctatatgacttgtagcattttgggaatagatgatgcgcttaacatattgc      219660
tgttcatttatgtgaaaagatattctgctattgtccaaagagagtgtccatttgcaaaatatctagtgt      219730
atgaagacaagttttattttcattttttcccttgtctttatattttaaatgtagttataaaatgagagaac    219800
atgggttcacaaagaaacatgaaattcataattaataaatgtgattttctattttgttttaggtatgcaag    219870
aggcacgtttgtgtgggagctcaaaaatgtttaattatttttaaatctcctttcactaatttaataaattt    219940
tttttgagttcagatgcaatctattacacatgtttcttgattttagggcgattctaccccaacatgcaaa     220010
ataaacaagagatccttctagttctttacaagtttcttagtgaaacacggcacttccctgatgctttcat     220080
gggtgggaactggagtgcacaggtgctggaacttgctggccacttcggggcaggcagtggcaatctccat       220150
tgactcactgctccaccccctcacaggaggagaagcacatgtgagagggtgcaggagccaagatgagcaat      220220
tttggatgccagcaattttaggtgtaaggaagaaggaactccatatgtcccctttatctttgccatctgcagac  220290
agggtgtttgctaccctggaagccccagaggaagtactacagtgtcccttttatctttgccatctgcagac     220360
agcatgttaacagctcagtggtgggtgggtgtgacagcctttacacccacactcatggcacctaagttc       220430
ttgtccagcctccaggaacaatgaagtcacacaaacaaatttgaaatggtaaatgtggggatttttattgc     220500
cagtagaattgctctcaggggaagggaagctgggatagagcagaaagttaaccttccctagaaatccag        220570
tcattcatggtcaaaatcctctccaaagctgcaccatcacgatgtacttctgaagtcaagccacttctct      220640
ctgatgtccaaccattgtctctaatgtccagttgtattccctctgctgtttatgcctagagttttttat      220710
gggcaccaaatgaggggcagggagggccatgggtggttttgaaaaagcaacattcaagtaagaagacag        220780
gaatgtaagttctcactttgggctgtggttgcatgcttttggcttgagggtggagccctctccaggtac       220850
ccactctcttctgcccataatttccctgcctctgtccctatcaatttatattttatttaggtatgcaag       220920
aggcacattttgtggaagtttgaaaatgtttaattattttaaatctcctttgttcatttaaggaatgt        220990
ctttggagctcagatgtcattacacatgttcctgacttggggagcttccttgctaacatgggaaataa         221060
acagagtccctagtaatttattccaagtttcttaggtaaccaattatatgtattctacaccccttagcag      221130
tgagtgttcatgttgtcaaatttccacttgttcttaaatgagattaaaacacaacaacaacgatgtttaa     221200
aagtttcaactataagaatataaaatcaatgtatactcctttgggttttttctctaatttttttcacagaat   221270
tctggtttgcaaaaagccagtagctgatttatcttctgaagatctctgtctaaaattaataggtatactt     221340
tcataagcacacttcattttgcaggtgaaaaatttctcccaacattgtatatgatagtgatttacaag        221410
tcagtattttttgctgtaaagagcgtgcctctaagtatcatgtgaagtaatttaaattatgccatttttta    221480
gtaagcatgttgactgaatctcatgtatttccactgattccacactaaacaaactatgttttatttttac     221550
tgcatttgacttggtttatatagtttacatagacacttttgtatgtctaagcatgcctgagcattatact     221620
acatggcatggtaatgtggtttggctgtgtcgctactcagatctcatcttgaattgcacttcccataatc     221690
cccacatgtcatgggacagacacaatgggaggtaatcgagtcttgtgggtggctatcttcatgctgctct     221760
caaaatagtgagttcttatgatatctgatagttgtataaggggcttttcccctttgctcaacatttt        221830
gttgctaccaccatttgaaaaacacgtttgcttcccttcttccatgattgcaagttccctgaggactcc      221900
ccagccatgctgaactgtgagtcaattaaaccttttacttcataaattacccagtcttgagtatgtctt      221970
tattagcagtgtgagaacggactaaatacagtaaattagttctgagagtggggtgctgctgtaaagatac     222040
ctgaaaatgtggaagtgactttggaactgggtttaaacaggcaggttgtaacagtttggaaggctcaga      222110
aaggaagatatgggaaagtttggaacttcctagacacttgttgaatgacgttgaccaaaatgctaatagt     222180
gatacgaccatgaagtccaagctaaggtggtctctgatggagaagagaagcttgttgggaactggaata      222250
aaaagtgactcttgctatgtttaaggaaagagactggcagcattttgcccctgccctagaaatctgtggaa    222320
ttttgaacttgagagagatgatttatagtatctggtggaaggggaatttgggggttagaacccacatacag    222390
agtctccactgggacactgcctagtggagctgtgaaaaggggcatactccagacaccagagtggaaga       222460
ttgcaccaagcacctggaaaagccacagagggtcaatgccagctattgaaagcagctggtgttgaaggt      222530
gtatgcagcaaagccacaggtgtggagcttcctaaagccatgggagcccaactttttgcattattgtaact    222600
tggatgtgagacatggagtcaaagaagattatttttagagctttacaaattttggctgccccacaggatttta 222670
gacctggatgggacctgtagcccctcatttttgtgaatttctcacatttggaacaagtgttttttagcc      222740
aatgcctactcccattgtgtttgaagtaactaacttgcttttgattttacaggctcataggcagaaa        222810
gcacttgtcttgccacaggtgagactttggacttggacttttgagttaatgctgaatgagttaagacttt     222880
gggggactgttggtatgatatgatttgtgttttgaagtgtgaggacatgagatttgggagggtctaggga     222950
```

FIGURE 11A-44

```
ccgaaagatatggtttggctgtgtctgcatccaaatctcatcttgaattatagtttccctaatctcctta      223020
tgttgcgggagggacccagtggaggtaattggatcttgggggcagataccctcattctgttctcatcat      223090
agtgagttttcatgagatctgatggtttcagaagggcttttctcccatttgctctgcccttctccacgc      223160
tgctgccatgtgaagaaggacattttgcttcaccttctgccacaattaagttccagaggcctctccag      223230
ccctgtggaactgtgggttaattaaatgttttttctctataaattacccagtcttgggtatgtctttatt      223300
agcaacatgagaatggactaatatccatggcacacagaaatctttctggggagaaaatcatggtctacaa      223370
tatttcttactcagaaataaggggattctttgggaaatcatcttccagataaaatcatagcaagctgtg      223440
gcaggagatttctgaagatcaaacatccttgtatgtgtctataaatattatctgagtcagcactcacaat      223510
ctgataaatgccctatgtgttccagttttcaaatggtaggttttgagacagaattcacatgtcagatgag      223580
tcacataaatttgcagaatgtctgtgaaggggcatggatatctttggttagtaactacccaaccattttc      223650
caaagtggacttgatctttggtattagaattgagaagtccacctgacctaaagagaataaggtatcatca      223720
ggaagaaacaatataaaacaaatttttttactgttccattagccaaaggcagatgatgtcttagagatgt      223790
ttggttacatagaggagaatcaaattaaaacacacaaaacaaagctatcctcctattaatatgatttact      223860
gtataggacacactaatttacttggtgagaaaagaaaatggtttagggtacaaaatgcagttagataga      223930
aggaataaattatatgattggataatgtggtaggaaaatgtatatttcaaatagctggaagagaagaat      224000
tggaatattcctaacccaaagaaaaaataaatatttgagatgatgaatatcccagttactctgattggat      224070
cattacacattgtttacaggggtgaacatattacatttgcctctaaaatatgttcaaatgtattatattg      224140
ataataaataagtaaataaatggcaaaaaacagcatttccaaaagagtatatttctattaataacttttt      224210
aaagggaaagagtccgatgaattgcaataaggttaaaagacagaaagatcctgtctctaaaaaaaaataa      224280
taaaaataaaaatacataaatacattgccaaaaggttaaagaagtaaaaaccttctacacatccataact      224350
atagcaccattcttgctgtggtaactatggttttctctaggcttaaatattttaattatattttatattg      224420
atacttgctaataatataatatgtattgtatagatgacagactggcctttttgtgatggcttttgcttgc      224490
ttggcgtatggtaaaattatttatgaaacttaggaaaaaggtttttatattttcttttttcttagtat      224560
tgtggagtacagttcaaactaactaggaaaattaaagacctaagatattttataattatattaatatcat      224630
gagtaattacaaaaataacaataatgactttcactctgttttccagtcctgttcaagatatttacatgca      224700
atgtccaattcaattcacaaaagcaataaaaagagacgctatttttttttccatttgtcaaacagtaaag      224770
ctaaggttacagtctttcttattgataacctggtggtgatcttttgggatatcattggaatcccattggt      224840
ttttctccagaggtacctgccattaagacttgttgcctcagtggttgatattggccaagacttcttaagt      224910
aaaaaattatttaatgttaggacttctgcctcacttttctaattagtggagcattttgcctctctacaga      224980
agagaatcccggaaaatgcaagagctgtctggtgttgcttagtgttcctgataatctagtattttcagta      225050
acgttaactcatatccgcagggctatggagggggtcacatatttttattcaattaaatgtcaacacttga      225120
gaaaaactttgactgtcagaaaaaaactgagtgagatactcagcaaattgtttaacagttggggagtttg      225190
caatgtctatgaaaactgttttacttttatagagccagagaaattttcattgaccctagcacagtgttg      225260
gtttcactcagggatgctaactttgctaatatatttatccatatactgatataataattataatatcatg      225330
cttgtcactcactttgtaacaaccaaccacattgtcagaaataacatttgttatcccatctccctcctac      225400
aaaaatcctatgagatcctaatattatcttgattttctttaaacaaataccaccagaggcccctcttct      225470
tgaattaagttgggtttattgactcttatgtatttctattagtattattattattcattacagataggat      225540
cttgctgcgttgcccactctggtgtgcagctgtgtgatcataactcattacagcctccaactcctgggct      225610
caaacaatcctcccacctcagcctcttgaatagctgggactacagttgcctgccaccacgtttggctaat      225680
ttttatttattttttttttacaggtgtgatctcattatgttgtccaggctggtcttgaattcatgacccca      225750
gatgttcttcccacttctattgactctttacaacaagaaagaatatgtacatagggatgtctcagtaca      225820
agggtaggaaagagttagagaattggggcttgttttaaatgatttacagagggttctggaaaactgtgct      225890
tgaatttgaattgatactttcaggacgtgttggcagttctatgactggttatcttaatctttatgtaaga      225960
ggaggaaaaatgaagcataggttaaagcaaggttgacaaagaaacaacagtcactgatgataccaagga      226030
caggtggacacttgatcatgtttgagtgtttgaataaccacttttttgtgtaagtgtccagacatgatta      226100
caatgtggtcttcattttgtcttgttctttcatgatcacacagtggttttttccttctgtcactgttccat      226170
tattattattattactattatttatattcaatagaacaatggcacaacctagctgcaagggacagga      226240
aaacacccaggattgccagggtttaggtgacattgccaggtcagctgctgatcaccagggattgcttttc      226310
tcttttgtgagtaactgaatattaaataaaccgagtaacatatcccaaatcctaccgagagttggaggta      226380
atactggagtctcaacaaagactatagaggagagtctagccccattcatctccaggcttttctctaggaaa      226450
ccaaagaccaatattatatttgttgcagaaaagagacacccctatagtcaacataatgtccagtgagagtt      226520
aattttaatgaggttcttttcagaattcaagaaagctggagaaaagaggcgttgtgtaactcacatacc      226590
aggaggcatcttctgtagctagtcagcagatgcctcttccactggagggatgcgatcttaaggataggag      226660
aattccattataaccaagaccgcttcattcatgggcctggattggatagggatggcccataccaaggtc      226730
tttgattctcgctttattgttacattctgtatgactgattcagatttgtccgcactaatatattttctc      226800
tggttctgatcattgtggccatgtcttcctagaaacaaaggccttgggttaattttttgcagagtaatgacg      226870
ttctcagcagcagctgaactctgtagatcaatattcctctttcttgttttcttccaatggcaactaaaca      226940
tgcaagacacatccaggagaagggtatgagattcccaatagctaacaccagcaataataatgcaacatgtaa      227010
ggctaatgcatgcccttgaaatgccaagggataaattcatatgcattttttcatttgggttttgaagagc      227080
cagatgacatgcaaaagaaaaatattgacaaaagatatcttatcatttattttcaattattaagcttgat      227150
tttcatacattcaaacttagtttttaacaggtacatgactctagtttttgaaagccagaagaatgcaca      227220
tataaaatcttttttgtctaacaaattaatcccatgtttcttggttctgatgcttgcatactgcttatgt      227290
taaacaattgtgagcaagcccaaactatactttttttttgagatggagtctcactgtgtcgtccaggc      227360
tggagtgcagtggcgcgatctcagctcagtgcaagctctgcctcccagtctccacactattctcctacctc      227430
agcctctggagtagctatattatacttattttaaaatgacagtacggctgaggtattcaaaatatgttt      227500
aaaggttctaacagaaacatgttagaaaaaagaagcttgacagcttttaagtttattagatacagaaat      227570
ttatacttagatttatttagattgaaaattaatcctaaggcatttaaccagctgggagagcttatgcatg      227640
catacgagtttcaagctgcaactaaggcagttgggcagcagtagaaacaaaagttgatatttattttct      227710
ttcagaaccaactgtgactgaattaaccacaaaagatcagcagggtatttgggcctaggtcatgttgatg      227780
gccttttgggttttagtttgctttaggggttcattgctgcaaaaggaagcctcctctacaaatgagatgag      227850
actgcatgagtacaaagcagagagatgcagtgctttctacagcactgagtaggcaaattgtcagatttt      227920
tcagtagaatctacttaacaccaatccatgcatttgcattttattaaaatgaaactatgataatttaaac      227990
tgcacattgcagatatgacctataaaatgtttgatgtcctatttttaacaaaagttttgaaaatttgcac      228060
```

FIGURE 11A-45

```
tccatatcaatttctctacttatgtgttttagttatttttgtaaagaatgccagatttttcaaagcaagt       228130
aggccaagaggatgatcttttttttcctccttttttttcccccgatgtttaaaatgcaactgccatggggc      228200
tgtgcccttttagctgttggaaaaaataatctactatgccttggttgtatgtgtgagtcaccagaccttc       228270
tgggaatgattctttggcacattctaccaacaattaacatgatacaaaatcattttcatatcttgtgat       228340
agtgtcagccaagtgtttcatacacatggagataagtgctgaaaaaggtgtttgaataaaaattgttttct     228410
taaagcaactatagaggatgagataaaaggatgcacaattacatttcataaattgagagagtttcctaaa      228480
caagagagcattcctggaaatgcagagaaaataaaaagatcttaaagatgttgtattaagataagttag       228550
actaaggcagcttggacatgtgtctcctttacttcatgtttatatataagtaaacattaaaagtagagga      228620
atttcagtttccacataacttatataggagcaacaaatggggcttttcaactactgaccacattggcatat     228690
cacccaatgtttttctttcagacttctctacctacgacaaaaccattgtggtattagagcttcatgaactg     228760
tgtatctttgattagttgatttaacctgtctggccctcatttttctcatctgtaaaataattgagtctta     228830
tgtgatttgaagatcaaaagaattactacacaaacagtgctagtaagagtccctgccacatagaaaggct     228900
agtacacacacacacatacatatatacacacaccccctcatactttatatattaaaggtgtatgattta      228970
tgaattattgcattagaaatgtaaatctgttatatatatacatatatatgataagtgaaatacagattatg     229040
taatttacaccacctatttattttgtaacttcgtaaacagattttgaaattttatttttgtgtgtatgt      229110
cttccaagtcattccctaaacttcattaaaatcccttgatttatgggaaaatatctgtatatatcaggt      229180
attcatatatataacacatataactcttctgaggtatataaacacacatatatttataacatagaaaatta    229250
ctaactcatatatgtgcctatctatataattttcatatataacattgtatattacatataaatattta     229320
tattacatacgaataatcatcacgttctgacagaatttgttaatctaacctccctcaaccccacccaaa     229390
aaaagtagaaactaaaatagaggaattttaagttccacatgatttatgtataagcaaaaatgggacta    229460
ctgactacagatcacgttagctaattgtacagttttctcttctgtgcttgttgtaaatatgattttat     229530
ttaagaggatattattaattatctatacaagaattggctatcttctccaaacttctacttcggtttcatg   229600
ttttttaaaagggggtgaggataggctgagcacagtgactcacacctgtaatctcagcacttcaggaggcca  229670
aggcaggtggatcacttgagggaaagagtttgagtggccaatgtagcaaagtctgatctctgcta        229740
aaaatacaaaaattagccaggaattgtggtgcatgcctgcagtcccagctacctgcgaggctgacacagg    229810
agaatcacttgaacccactaggtggaggttttagtgagatgagatcatcccactgcattccagcctggt    229880
cacagagcaagatactgtcttaaaaaaaaaaaaaaaagtgaaaagggtgaggattgttatttctatgg     229950
gcaggcccacacagcattggattcctcagaaactgcacagtaaacgggagtctcttagcacatctgacag    230020
aacttcaaggggctgactgttcattatcccacacgccactctgctctgtctgtaagtggagactccatgtct  230090
ttgttgtcttgcagtccctagatgataaggggcacagagaaaaatcacagaaatcaaacatggtagcacag   230160
aaaaacaccccaaagtcaaggataagatgaaagttgtgatcgtacacatcaaagtcggactcttatctag    230230
atgggcacacctaagccacaggctgacaggctgagattctacaaaggctctggaccccagataagtttaa    230300
gtgattgcatcgtgatctcttcttttcattggtggaggcagtgctttgaatgactaagctggatatcact   230370
ttccagggaatcctttaggggaatgtgaccatccagctatctctgagtgtctttggtgccataaatactt     230440
ttcacttggttgaggatacttttagttttatattcatgcgtcaacttgtacagaaatgtgtgttttgggc   230510
ttgtaaaaaagtttaatcataagacaaaggctacaggtttcatgtttattcacagtttgatgaacggca   230580
cttatgacacatatgtgtatacggtaagtgctcactgaattcctcttgagtgataagctaggatacaaa    230650
atgtcagaagataaagagtgaggatgggcactggatccaaatgtcagtgaactctgagggtctcttgctg   230720
gttgaaacaacagagtactttttattttcattctaaaccctccatgtcctataccaatgaatc       230790
acctcctcaataaccccctcaaacatggcatctttgaagtagagcctcattgacaagcactaattaaatgt   230860
ctgtcatggatactaaaatgtatatacggcctttgtgcctggacaacagtacatgtgtcagctgttctt    230930
aagcctacatccaaccattaagtaaagcccagtgcgctcttagttcctcaaatctgttcaagtcttgatg    231000
tttgttcaacattttgcctggctccagtcatatgtctccagctatctgtaatggactcaatatcctgctt   231070
ataaaatgcttagtcatgtggttcattttttggtttagctgtataggtcaggaataagttagaaataac    231140
caaaatactccaaatcaagttctagctgttttgatacaaacattttccatcaaccttacttctccctaac   231210
tcatctgtctgtttctgtgccctttcccatggggtaaaacctttttatagtatccagatgccttctacaca  231280
cagaagcaatttttgtgtcaaaaggctccccaggggaagaagaggacaatgccttcatgggaagctcctttc  231350
tgttaaatcggatttgcatacctaaccaaagcatttgcttcagttaaccaagtgagggtggagaaagtct   231420
tgcaaaactatagctcaattgtgagaggggattattaaaattattcagtcattcattagaggagctttgacaa 231490
agattgcagaaacagatataaaacaggaaatattaacaaaaacattctcaaaaatattttataatgtcca    231560
gaacaactggcatgactaacatcaaagaagggatatgttttgacattgatttactaaccacttatcattg    231630
atactaaatcctccttgaatactatttacgattaagacagtcaagttatatgagtatgttcaaccaac     231700
aaaggttgcaaaacatagtgaatttaatattcctctgccatatgccatcctacacttctgcatcacagt    231770
catggctctgcaaatagatcagactttttggccagtccccttggggtcactgcattctaaggtgcttgac   231840
caggaagtaagatgctcttctcactaagtgatatacgtgtggtccttgtggatctgctaagaatctcaga    231910
aaaggaataaaagatacatgaaattgtttgcatgctactagctctagtgggtagattggtggcatatttc    231980
ttcttggcaaaagacagaaagtatccaaaagttcaccatttttctcctggttggggaatggtgtcttta    232050
gaccatttgttcaaaagaaaggtaaaaatagcatgaaaagagaaccctaaattgccttactcaagcct    232120
tctactctaagtgacttgtataaaatgtcttgttcagtagttacccaactccaatctacccctaagaggt   232190
tctagtaaagtacagattagctggatttaataaagcacaaatggtagcagatgcattcttacatctcaa    232260
tctaatcggtaaccttctttatcctcacccatggctgactactatgcataaagaataggaattctgacca   232330
ctcaagaatcttaaccatacattcagtctgttgcagtttctcctccattacacatttttttttttcgctt   232400
ttctatccttggacagccacagacaggacaactagtcaataagaaatgagtgtgaaggtgacaactttcc   232470
tcactaagaggatagggccatgagagggaaaagggtacttcttgtgtggctggtaatggagttaaaattt    232540
gatgctacagtcttctgggagcagcagctgtatgtgcttgaacttttactttggaggcatcctctaattcc   232610
aggggttctgtggccagtaccatccactgcagttcacttaacttgggctgagtctgtttcttccctccat    232680
cacttcagctggacctattctttgaccctcacatggttccagtggtgaaaccagggaagagtctctttg   232750
tagaggaccaaggagcactttttctcatgtagtgcacatttggctccatcaccatcatagctaacatgtc   232820
caaccctccagcatcttcaaccttcgccactgtcttgcgccataaggcctgataaggctgatg      232890
ggtcatgtatggcagggccacccaacagtctagtaataggtcttgcattgttggacacacttcttgatt    232960
tagaactatggctttcagtcatggttaggtgtgccccagttggcaaggtaaggagacatttccagttgtt    233030
acagtgagtttgaagggtgttaatgcatttagttcatggagaccagggttgctgttcaatatcctacaat   233100
gcacaggacacttgcccatagcaatgatctgattccaaatgtcaacggtgctgacatcagtaaaccctgc   233170
```

FIGURE 11A-46

```
tctaagtcaatgcttttttgtatgcatattttaaaagtctcctccagctaaaccattagcttttaatgg        233240
ggtatacattttctttccaagggatgtttggttatgcctggagacactttcagtttttgcagccagagt        233310
ttggtgatgtttctggtatctaattgatactaatcctagatgctgctcaacatactactatgcagagtat       233380
ggctcaccagaacaaagaattatcccattcataatgcctctagaattaagattgagaaaccttggtttag       233450
aatacaggagagctagtggtatcctctaagatgctgtctggaagcagctttgaagacaagcagagacca        233520
gagactttgaagccatactcacagggtttgatatagtttggtcttctccaaatcttgtgttga              233590
aatttgatccccactcttagaggtgggacttggtgggaggcatttctgtcttgggccagatctctctcat       233660
gaatgacttgatgcagtcctccagatgatgcatgagttcttgctctgttatttcccgggagatctggttg       233730
ttataaataacctggcaccttcctctcctctctctcttgtttcctctctcgccatgtgatctgtgcacac       233800
agcagctctccttcccctttccaccatgaatggaagttcccttagtccctcatcagaagcagatgctagta      233870
ccatgcttcttgtacaccctgcagaactgtgagccaaataaactttttttcttttcttttttattcttcta      233940
attagagacaggatcttgccttgttagaaaggagtacagtggtgcaatcattgctcactgggagcatcaaa      234010
ctcctaggctcaagccatcctctgacttcaacttcctgagtagctagaactacatatggcatgcctccat       234080
gtccagttaatgtttattaaaaatagttgtagggacagagtcttgctgtgttgcctaagttgttctcaaa       234150
ctcctgacctcaaaggatcatcctccttcatcctactaaagtgctaagattacagatgtgagctgccatg       234220
cctcgactgtcttctctcttttataaattactcagccacaggtattcttttatagcaatgcaaatggagtaag    234290
acattgtacaaatcccacattaggcacttatagatctgtctgtgattctggacaagttatttaaccactc       234360
tttgtgtctaaacctgttgtttgtttctttcttattccttatcaggtccagctccaatgatgataaaaa        234430
tatagatgtaaatggagctaagaggggtgcctgaccaagagtaaacagtccagaagtgttattctgtcaa       234500
tatgacttggattttttgcttcgaaacttcagctgaaactgacatgacaggaaaaggcccaaattagaatt      234570
cttcttatgcaaaattccttctctgtgaggaggtagcccatctgttgtcaaataatccgagttgtagaaatt    234640
tattaaatttctcctttcttgcccttgcctccttcattaaatgaaatcagatggtgacagtataaggaa        234710
gttaaagtgaaggtaaaataaaacagacaggaagaagtctgtcttcagattagacatgcaattattcctg       234780
tctttgctgctgatttcaattataactcattggaattatcagtccacaatagatgttccctgcctatgtg      234850
gtgtttttaattaaacgttgacatcattctcacatgttcactgttattagcactgatgatgtaatcttc       234920
atgtttcctctgaacactgcatgccaagaaaggggccctctatcctcacggatttctctaggcaagagaa       234990
tatcaggccctcatctgtcatatttccatctcattcagCACAAAACACCCTGGCTCATGGAAACTGCAAG       235060
CATCGTTGTCAGCTGCACCTGCAGGCACCACGGGATTGCAAGTCAGCATACCCTTTCAGAAATGAGGATG       235130
AAATTAGAGgtagagagaaaattctccactgtcctctcacttgtctctgttatggtttctgctatgtttt       235200
cattgattatgctataggyagaaaggaggaaaagaatccccctaagagaacagtgtctcactggacattg       235270
tttctttgcaaaaaaaaaaaaaaaaaaaaagaaaaaaaagaaagaaagaaagaaagaaagaaagaa           235340
agaaagaaaaaagaaaaagaaaagaaacattttggtattttcacttttccaccctagaatctagat           235410
accacctttaaacagatttgaatcccacagggagaatgtggtcatatatttcactacaaatgctagacca      235480
tgtcttctggcgtcagaaatgctgtattgtgcatgtgttcttgctgcaagccatcttcaacttggttttt      235550
cagggataggcaaaacattaggcaatctgaataaaattgcatttcttgcaactgaaaattttgcatgca       235620
cccacatacgtgtattggtattactgtacagcttgcatggtgcaaagctgaaggctaagggattaaagga      235690
ggctgaaatttagccctggacacactgtgcagcctgggtacctgtagggctgcaattcctggctagaggt      235760
gtgtctatttctcatgcatccagtagaaggcacccttttgaaggtctctcaaccctctcctcattcccct      235830
ccacctatcatatttagcatattgtgtatttgtccttagtctgtttaatccaacttgatcactttgtagc      235900
cttttcttattcccagtgtgtaaatcagtattttgaatgcattgagctaagtttcagacatatgccttc       235970
caaatagactatcatgaaggatgctattctggcgcagctatgcattctcttctgtgtaagaatgctcatt      236040
gtgtagtctctcctttttaaagtctgtttagtgtaatgttcgctgacttttccatgcacctcttatgtaat     236110
cttttgccagttctaccattcccaataaccaatgaagatacttgcttcatgttaaattctaagtaatcta      236180
cttttctattgaactaaatcatttctccacaaaatgtctttgaataattaaagatcttataatgtggtttc    236250
catagactgaactgaatatttcatgtggctagataagtaggtaaagtacagtatagtagcaattggtgta      236320
cacacttagaatgtcctaataaattattgcagatactgatatgcaatgagaaagaataactgtagtgtta      236390
agcccccagatggtattatagacctgagggtgggtgaagatgggcctgggattaatggattgatagctcag     236460
ttcatattggagtttcatatctgagattcagtgaattcgaggctattcttcacctgctgcaattctaggg      236530
aagtgtgtccattgaggagtcgctgaagggctgggagtttggatgggttctttcaatacccaccttttt       236600
aaaaaaaatagtgtggctctgtcatgtggagtgcagtggtataatcatggctcactgcagctc              236670
aaactcctgggctcaaacgatcctcctgtctcaacctcccaagtagctaggactacagctgggcaccacc      236740
ataactaggcaattgttttaaaaactttgcagagacagtcttgctatgttagttagggtggtctcaaact      236810
cctggcctgaagcagaccaccaatgttagccttccagggtgctgggagtaagacatgagccaccgtgctg      236880
aactgcaatatcttttttaattagcgggaagtagaaaacagaaattctgcagcatgttttttcttgttaaca    236950
tgaatcagtcttgggtgaagtgtccatagttttttaatgatatttttcaaaatgaacaattagagacaggc     237020
atcagaaaccacaaataataaggccatgtgaaggaacacaatagatgcataaggttaattggtcagcatt      237090
tatgctgcacttagtttcccgttgattttttttaatgagtttgaagtataacacacagaaaccaaagtt       237160
ctgtgttttgtattatgttatattatcaatgttcagtgcaatttgaaagcctaaagcaagtatttctgta      237230
acaaacacacattttcaagaaatataatgttcctatcttcaaagcaattcatgctctttttcccattttgtct   237300
ccttatcctcctcagtgataagcattttttctcttatgcttttctttatattttccatgcttttctttata     237370
ttttcccaaaaagaaaggcatccctgcatcgcataaattttgcttgtttggagatactaaatgaatgcaa      237440
cttcatattactttccgatgtgttcttttcaggcataattctgttttataaaattcttacatgctgctat      237510
gtatacattcattccactactttttaattgttgtatagtgttctaaaatctgaatatatcacactccatat     237580
ttccattttattcctaattgatacagatactttttccagttttgaggttattatggactcgtgttatgaac     237650
gttgttttcacgcatcctcatttctcacaagcattgattttctgagatatataccactatgtaattgct       237720
ggttcaaatcttcaactatatactcttttgcagtacacaaatgctgttttcaccagcagtatgcatcgt       237790
tcaacatgtagcagtataagaattctgttttcttcttctgatctaatgggtgtatgtgaaactcactgt       237860
gtgtttattgtgttttccctgggattgagatgtttccatgtatttattggccgtttgttttttcctgatta     237930
gtggaagcatctgttttgttttttgattagttttttctattagattgtgtcttcttattgttttattttga     238000
ttagagtacttcattgattatgtgatgtcacaaatttcttcttatgttttttgtttttaattatttcttat    238070
ctatttttttttttttgagATGGAGTGTTGCTCTGTCACCCAGGCTGAAGTGCAGTGGCATGATCTTGG       238140
CTCACTGCAACCTCTGCTTCCCAGGTTCAAGCAATTCTTCTGCCTCAGCATCCTGAGTAGCTGAAATTAC       238210
AGgtttgtgccaccatgcctggctaatttttgaatttttagtaaaaacggggtttcaccatttggtcag       238280
```

FIGURE 11A-47

```
actggtcttgaactcctgaccttgtgatccacctgcctcggcctcccaaagtgctgggattacaggtgta        238350
agccacctaatgatttctttaaagttcttactcttagtttacacactttaccataattttttttcagatta        238420
gcacttttgggattttttgttaatggtatcttttcctactcctagatatgaagatttccttttactttatct      238490
gcaaaaaggcttatgatttttatctttgatattgaaaatacacattgatttattattgcattcgtaaga          238560
ggtgtagtttattttcccttagaatgtcacaactctttattttaaacaatttaacccatatcactaaa           238630
gttcaactggtctctgtctaccactgtgccagtaatcacattttttatcatcatgatttataataatac          238700
aaaatatctagtatagcaaatattctttccttgttcttttgcaagagagtcttggctatctttggtgtgt         238770
tgacttttgtatgaatttggcataccccacctgaaaaataaataagcatctgattttcaattaataatg          238840
aattgaattaattaattacttaatctcaaggctagtttgggctgattggacatcttttaaacattgaacag        238910
acatattcatggaattgtacatccttatacacatttatgtattttagatttttttctatttcatattctg         238980
tactattttgaatagcagtctttttatacattttggttaattgatttgtaagaaaagatgttttcaaaagt        239050
atggtaatgtttgttttaaaatgttcattctctgttattgctaaaatggaaaatgccattacttacttgt         239120
tgaacattaattttgcaacttgtgaaactcttgtattctttgggatttcctagaacacactcctatcaac         239190
tgtgagtaaaaacaatttgctattcctttttaattttttagatgtgtttattttttctctccttaacagct       239260
cattcgtgtaaccccttcaagtacaatgccaaatagaacaagacttgagcatctctttttatgactttgac       239330
tttaaagacaaggtttccaacacccctaacccattaaaatgaggtcttcaattctactgactttagttgt        239400
gaatttttattagattaggaaaattcccttttattttttgtttgctaaaatattttttgaagctgtgaatg       239470
aatgggtgttgcatttgttattctttactgaatgtagtgtggttttttggtttctttttttctttttcttt      239540
tctattttattttattttattttttgagacagagtcttgctctgtcacccaggctggagtgcaatggcg         239610
tgatctcagctcactgcaacctctgcctcctgggttcaagcaattctcctgtctcagcctcccccagtagc       239680
tgggactacaggtgtgcaccaccacgctcaactaattttttgtatttccatagagatggggtttttactgt       239750
gttgccaggctggtctcaaactcctgagctcaggcaatccaccacctcggcctcccaaagtgctggga          239820
ttacaggcatgagacaccgcacctggccaattttttttttctcttcaatgtcactgtaatgatttattat        239890
atatatattacattttgtaacataattataatatatataatatattttatatatataaaagatgactttat       239960
ataagatatataaaagatgattttatatatatacataaaagatatgactttctttttatatgtgtttatatat     240030
atacataaaagatatttatagattttaatattaattccacttttgtgtgttgggatgaacctaatttgaga       240100
attatatattcatatgcttttcacgcattgccgaaaatagtccctgggtgatgttgttggcaactttctt        240170
aatcctattctttgaattttggatagaagttacactatcatacaataaaattgaaatatatgtcttttt         240240
ttaatacttgaagagattaagattggggatatatcttcattaatatgttcctgaactaagaaatacacc         240310
gtctccgcatagttttcctttgtggcttgagttttggcagcaaatttgatgtcttccttttcttttgttct       240380
ttgttttgagacagggtctcattctgtcatccacactggagtgcagtagtacaatcatagcttactgcag        240450
cctcaacttcctgggctcaagcaactaatttggtatcataaatgatgggggactgggtgtggtgtctca         240520
cacctgtaatcctagcacttgggaggctgagacaggtagatcacctgaggtcgggagttcaagatcagcc        240590
tagccaacatggtgaaactccgtttctactacaaatacaaaaattaaccaggcctcgtgtggtggcctg         240660
taatcagctcctgagtaggagggtttaggcaggagaatcacttgaactcaggaggcagaggttgctgtgag       240730
ccaagatcacgctgctgcactccagcctgggtgacagagcaagaatccatctcaaataaataaataaaca        240800
aacaaacaaacaaataaatgatagaaggcttattcagatgtgtactttgaatcacttttgttctactat         240870
acttttcaaagaagtctttttacttctttttaaattttcaaattttttgaaaatgccaaggaactaatttt      240940
tggttttcctcttcattctattttatgttgttttttccattaactactgctatcttaattatttactt         241010
ctgataaatcttgctgttgtttttactgtcttcttgaaatgctgattttattaactttaagatatgcttct      241080
tttctcatatgttaatatatacctggaaatttgctcaagtactgaattagctacattccacaaatcaga        241150
taaatgatactttgcttttgttcagatcaaactatttttgtaatttctattattaattttttagtcatgaa      241220
ttatttcacagattattcttagttccaaatagacttgttttttttctggttgtttatattttttactact       241290
tcatttatttctcaccagtgtgctttgcatacttgagaaaagtatattttgcaatggttggtgcaata         241360
tgttatatgtctaatatctcagactgttgaagtatgttgctcacatactctatgtagttttataggtagt       241430
ttacatgttctttcagtaactaaaataggtatatgaaatttcccccttgatgtttatggatgtttaaaacc      241500
tttcctatatttttttcaaactttagttttttgtgtttgacgtgcttatcaatttagtggatatggtcta.     241570
gaattgttattgaattgtggcaaattgaggttgttctcattataaaatgatcctcttttaagtttgtggt       241640
gcttcatgccttaatgtctgtttagtctgacattaacattacattaatgtttaatgttaatgttatctta      241710
tgttttgttaataatcgaattgtgtattgtttctatgtgtttacttcaggcctttctgctggctcaggct        241780
ttgagtgttttctatgtagcatctatttgggtctcattatatttgacttttaactgcagattcactgata       241850
tttactttcatgttttatgtatttgtgttcaagtcctctatcctaaattgtgcttttaatatctcacttc       241920
tatatcttgcttgaattgcttttaaaaatcattccaggccaggaacagagtctcacacctgtaatccc         241990
agcacttggaggccaagacaggaaaattccaccttgaggatccctccaggagttcaaggacagcctgagcaa     242060
catagaaagatctcatccctttgaaaaataaaaataaaaattagccaggtgtggtggtgtgcacttgtag        242130
tcctaggtactccagaggttgagtaagcaggagagtttgagcccatgagattgaggttgtagtgacctgt       242200
gatgacaccactgcactgcaacctgggcaagagccaagcctggaacaagatcctgtctcaaaaaataaac       242270
aaataaataaaattattccatttttcttttactcccacttctcccactacactagctgttaaaagactgtac    242340
tactttagtaaataatcctagaaattacaacagtgggtccttaacataatcactaaatttaattaataca      242410
tttcctcttctctgaaaatagttagtaatcagtgtgttttaactccatgtttatgacctaacttacttgc      242480
tgttagtacctttcgatgtttttgtgttttttaggaatcttttttcagatatgattgcttatttttgttatttt   242550
caatattcattttgatttttttgacaattacactccttcatttgtgtttcattctctttgtacctcctac     242620
tttatctgtgattattctcttacaaaatctattggtgatttaaaatatattttcagagctagtgagctgt      242690
tggaagctctcagtttgcatggctaagtctgtcttatccactctttgaacaatttctcgttgaatttt        242760
aatttttacttcttttcagctattcaagaaatcattctcctattctctggattccactgttcctatggaaa     242830
tttagctgtcagtttaaaagttacatacttaaaaataatatatttgggtggctacggtggctcaagccta      242900
taatcccagcactttgggaggctgaggcaggtggataacctgagttcaggagttcgacaccagcctggcc       242970
aacatgatgaaaccccatctctactaaaaatacaaaaattagccaggtgtgatggtgggtgcctgtaatc      243040
tcagctactgggaggctgagacagaattctggaacccggaagtagaggttcagtgagccgagatca          243110
caccattgcactccatcccaggtgacaacagcaagactctgtctctctctgtatatatatatattaaata       243180
tatattaaattaattaaatattatatattatacatttaatatatatatactatatacacatatacacaca       243250
tatatgtgtgtatacatattttatacatatatatatatatatatatatatatatatatatatat            243320
ttggtaaagtagtttgtatccccttgataccttttaagatagttttgctttcagtttctgccatttcagt       243390
```

FIGURE 11A-48

```
gtgatactgtttggggtttattaatctgattagaattccttgatcaccttgaaatctgccatgggctttt       243460
cttctgttctgaaaatagtcacacctcttcaaatattgctactgtttcttctgttttcagtgtgtttgta       243530
cataatttagattttctccctctggctccttttttagtttttgtgtgtgtgtgtgttttgcttttttaaaa       243600
atcttcattttcaagcttcattctggattaattttcctataacctacttcactaattctctcgtttaatc       243670
tatctaatccatggctaaaccaatgtgtccaatcc
ttaaatttgatatgtattttcattacatttcaagg       243740
ttgaattttgtttcttctcagtttccacatttttaaagttctcaattttgtattttcaggaatgctttc       243810
ttcctggttattttaaagtctgcatctgttttttcttccttttttaccccccatcactcttatgtttctt       243880
cctctttgtttgtttttggtatcactgactaatatcttcatggactaagtattagaattatgcatatat       243950
tcagcattctcattttgtttttcttattctagctctctattttatattctttgtatattacatctcatg       244020
ttgttgcccaggctggagagcagtggcacaatcatagcttactgtagctttgatcttatgggctcatgtg       244090
aatctcttgcctcagccttctgggtaagtgggactacaggtgcacaccatcatgtctggctaatatttta       244160
tattttaatttttttttagtgactagatcttgctctgttacgcagactggtctaactcctggcttcaagca       244230
atcctttctcctcagtcttgcatagttgggattacaggcctaggcactgcacccagtttcccaacgttt       244300
ttcttctttgcatgatactctctggatcatttcttctcatctcttcccaagggtatacgatatccttttt       244370
aacttttctgccct
taggcagatgcattcattttctcattttgtttatttctctgatctagaaatttgat       244440
ttgatctttatttttcattcttaatacttt
cttattcctggcagatgcttt
ccaacttgttgttttcaa       244510
ggtctttgaacgcccttcagaaaattggttatcatatatatatctggtgactgcactatcataattcttt       244580
tggcattccaccagcttttgctggtgacttttt
gtttctttcttcatgggtttggtaatctttgtgaat       244650
tggctgctgtatttgcaaatggattaagggcatcttctgaacctgtggacactggaattcaaggttcttt       244720
cattcactgagccatgctgttccctgaatttcttagatgctatgaaggtagattacaagtcct
tgcaaga       244790
ccgaatttacttttgtttaatgcttgccttcagggggaaacctacaaggtaggaaaatgttagaggtgag       244860
tatattagattgtataccttcaggagtgactacggtttgagaattgtcccattatctgctgatgctgcaa       244930
gaaccctaactatttcttcaagattggaacagtgcactaaggcaaaggctgcactgtgtgccaggcgtct       245000
agatagaccatcatttggtcatcagtgttttttgtttatttggttggttgattggttgttttgaggcagg       245070
gtctctctgtccaccatgctggaatgtagtagcatgatcatggttcattgttgcctcaaactcccaggctg       245140
aagacttactcccaccacagcctcccccagtagcttagaccacagatgtttgccaccaggactggctaatt       245210
tttaaaaacttttttgtagacacaaggtttcaccatgttgcccaggctgtgatcatcagttttgaagctat       245280
aatcttaaatataaattttagcactgaaatgcttttaagagacttttcaaaaatcacacatattacaaccc       245350
actttcaattagaaggttggtctgaatgatcttctctgttactgctagatgtagacttctgatttccgct       245420
gatatccacagaaatgactaggtagaacatgaatttatagatcaaatatcttattagcactcca       245490
ttatctcaagagcagttctggattcagagaatcatgactttcttttacaggcattaaaataagttaaatc       245560
agcaatattatttctaacaactaacacttcaaagaaatgtcagacagttaatcatcacctgacaccatag       245630
ctcatgcaaatcgtgtttta
ttaggatttatgttactgctagcattttggatgaaaagatactgttttt       245700
tttt
gttttgttttgtttttttttgttttt
gagacagagtctagctctgtcgcccaggctggagtgcagtgg       245770
cgagatctcagctcactgccagctcctcctcccaagttcacgccattctgcctgcctcaagcccccgagta       245840
gctgggactacaggcgcccgccaccacgcgggctaattttttgtattttagtagagatgggg
tttcac       245910
catgttagccaggttggtctcaatctcctgatcctgacctcgcgatccgccgcctcggcctcccaaa       245980
gtgctgggattacaggcgtgagccgccgtgcacagccaaaaagatattaacattttctctgaagcactg       246050
agtcatacttttgtttttttcacaagattttttacacttttcaattagtatgtgagtgttcctcaggaaat       246120
gcatgtttggctattttgctgtttttagagtgtttcatctttgaaatgcatgattaaaagccattttagaa       246190
attaacacgagtgtgtttaaatacaaattatgaagccagtgttttgtttcaaacttagggatataatctt       246260
ttttttccaagaaaatgctctcatttatatatacatgaggttatgtaagacttttaaagattgatgatgg       246330
atttagtgccagctgttgattagtatgtctgcaatggatctacaatatggcaataacactaggtactatg       246400
cagagttactgtgaataataaatagacacgattgtataattcacctagcagacttattttgtatactat       246470
aattattcaataaataatggcccttgtggttatttatctattgatagatatttatgttgatttatctact       246540
gatcagtcctatagcagtaaatttatctttaaaatctagacacattaggaaagaacaatgttagatttta       246610
tgtcaaaaataaaatttcttagtgtactaaaataatatattttttctattaatgcaagttaggcttttat       246680
attgattattttgaatattttactatgcttggtatgttttaaaaatttagtagttcttaatgcaattcta       246750
cttttaaaaacttttcattatctagtaagatttactagtgattaattttaatttggtagacatgaaaaa       246820
tacacaccagttttttcacacacaatcataaatcctgtacatcatattggtgaagcgggaactaaactgca       246890
tcaaatttccactaaataatgaagagcaatctatgatgtaattgaaatgttaataaatattgtagaaat       246960
gggaaattttcagaatgttcagatttgtcaagagaatctcaaagcgtgacacttttctgtaatctgtcat       247030
agataaatcaggtcttttgttatgttgttttttctcttttttatttccaattcatcacaaaaatatactttg       247100
gtttatgaatatgtaaactatagagtagtaaatttgacaaagtctacgtgttgaaaactacattcgacca       247170
ctgagggacactgatgaaggcttaaacaaatggagaaaagactgtattcacaaacacgacaccctcctaa       247240
gaagatacaatattgttaatatattt
attttgtacaaattaatctacagactcattgcaatcccaaatga       247310
aataatggtagacttttagaaaatacataaattaacaagatgaatttaaaatttaaatcaaaatacgaag       247380
gatgtgcagtagccaaacatctttgtaggagtagaacatattgggaggactcctgctacttgacctcaag       247450
acttagtgtggagctatactgattgaaacagggtattattcataaagatagacaaacagatcactatc       247520
acagactggagactccacatgg
aactacacatatatggacaatgaattttccaaagaaatacaaaggctt       247590
atcttttcaaatccaactggaagcaagcagctttagttatattataaaattt
ccactaactagaatattc       247660
ttgggtaaaaatgaagtgtcacctaaatggaattttcaaacttgcaccctatgtctgaacacgattcttt       247730
ttcagtcaggcatgtagttattgaggacacattctcagctgtgcatacatcccatccagttcagtccat       247800
agatgtattgaaagcatgtgcttactgcaagagcaatgcactagccttttcctagagttgggtctccaa       247870
agaaagggccttactcagagtatctgcccagggtacaagattgacttaaaaccagtgttaacaacacac       247940
atggtactctgaaccatctgctggaggacctccctgtgtctgacacagtctatctattgaatgtcatgga       248010
aaagattgatggttgaagcaaatcacttta
tgcagttagaaaaagaccatgctgatctttcagttttga       248080
gccacatctacctaatccacagtcagatttgtcagccttcactgatattt
gggacttcataattc       248150
tttgctttgttaggcttgtcctgcgcattgtaaatgttcacagtccagataccagtacataaatagatac       248220
agttttt
accaattaaaataaataattaaaaaaatcatctttacaggtaaaataataagcagccagacac       248290
agtggcttatgcctgtaatcccaacattttgggaagccaaggctggaggatcttattagcctgggatttt       248360
gataccagcctgtgtcatagttagatttgcctctaaaaaacataaaaaattagctgctgggcatggt       248430
ggtacatgcctatagtcccagctacacaggagacagaggtgataggatcacttgagctcaggagttcaag       248500
```

FIGURE 11A-49

```
gctacagtgagctattgatgattccaccacagtccgctgtaggtgacagagcaagaccctgtctccaaaa      248570
ataaaaaataagtaagctaaatacttttgaattgaaaaaatgtattctgtaagagatatctgataatca      248640
cctactatgaccatgttttcatccttcaaggatttcaaactattataaaaatcttctaaacctctatctc     248710
tttagtttaaattacttacatgaatttaatgctccagtatgtgacaacaattattgattttaaaaaataa    248780
tagatctgttttgatattcctttaccaatattcctcatgtttgtgagaaaatatgaggcagtgcagttga     248850
ctgcatttgtatgtatttaatatcatgagcaagtgggaaaaattcagaagtggcaccgagttgatcatct    248920
ctgttatcatcatgagaaggatgcacaatgtgaacattctgccatagggcttgtctctgtaaagtgcagg    248990
tcgagggcatgaagagcttctactattttaaaaacatcttctgaacagataatggaggcttaactgt       249060
agtgtaaacacgctaatgcacaaatcttgaaaaatgtaaaataaactgtgttgagattagaggtgatcta    249130
ttcacatttgaaggatagaaaatatgcctaccagccataaaaggggtgcatttacttttatttttgagaa    249200
cagcatgagagcagaaagacacattaacaaagggtaagagtcttcagagcagattactcccacttgaaa     249270
aaaatgagttaagtgatttttacagcaggaaagatatttgcagcaagaagtttcattagtcaccaaatgag   249340
gtttctctgacatatattttcacagaatgtgaagcatgaggaacaataaaatttctatattttcttgtg     249410
tttattcatttggctggaagattcccttccctagccttctgaagtttcagtcttctaatctgatttagt     249480
gaccttttgttcactaggaagaacatagtccatttacgtttgccaaagagtatttacatgtatttgcagtt   249550
taaacaggaaacattctaaaaaatagagggtgtgtttgttgaaacattatgactattaaagtcagagaa     249620
gttacctaaaacagaagatgctcagagtttgaaactggatggttattaatagatgcttcttttgtgttgac   249690
tggagtttaactgccagtccttttcttaagccaagagattttcccaaaagaaacacttcagttgtaggccc  249760
agtaaagaaactggaatctgcttttatgaattggcaataaaaagaaaaggtgggaggataggtgaagaaa    249830
agagagagggagtcttcagataggaaaccccccttgcttcccttggagtctcatcttaagatttaaatta   249900
aattgaagaccatattaaggaatagaaaatatcaggatttttctttgtgacacataatcaactttatctc   249970
tcaaacaatttacatgatgacttacagaacgactgcatgatgttgattctacaaaagatgactgaattca   250040
ttaggactactcatttgtcttcagttatacttctgcagtttcaattatctatggtcatccatggtcagc    250110
agaaaattccagaaataaacagtgcatcagttttacattgccttggttctgaatagcatgatgaaatcc    250180
ccagcagtcctgctccctcccaatccatcctgtccagccagtgaatcctcccttgtttggcatctccat    250250
gctggtaaggctgcctgatctttagtcatttagtagtcttctcagtgaccagatctgtcatgttactgct   250320
gtgtttgtgctcaagtaacccttatttcacttaacaatggtcccaaagtgcaagagtagtgatgctggca   250390
tattttacaattatcctactgtattgttagctattattattaatctcctactgtgcctaattgataaat    250460
taagcctttcataggcatatatgtataagaaaatgcatagtacatacagggttcagtactatctgtgtt    250530
ttcaggtatccactgtgggtcttggtacatacataacagaagactactgctgtccacatttgtagcaatg   250600
atcacctttctttcattgtgcaatggcatatttctcatttgcctctgatggctcatataaatggagtttt   250670
ctgtccatatttctagtgtcattctgttcaaagttgcataggtcttccttacgatgattaaggttttctc   250740
tgcagccctttatcttttttcctgagctctcattagaatcaccttcgacgttctcattggcttcataggc   250810
tctgtcgaccatacacttcaaaactctttcagattctacttattacccaattccagagctgcttctgaat   250880
ttgtaggtgtctgttatctcaataccacactctcaggaccaatttctgtcttaggtcattcaggctgcta   250950
tgatgaaataacataatctgggatggggtgggaggtggttgtaaaaaactgacatttatttctcacagt    251020
tctggaggctagtaatccaagatgaaggtactggaagtttcagtctcttgacagcccacttcctagtcca   251090
cagacagcaacttctccctgtgtccccacatgggaaagggtgagggggctcttgagatctcttcttttaa   251160
gggcactaagctcattcatgagcactccatactcaggactctaatgaccctctcaaatacacatcctcctaa 251230
taccatctcctgggaaagggagtttaggattttaaggttgaatttgaggagaatgctaacatttagtcta   251300
taaagaagacagtacaggaaaactacagaaatcaataaactcagctattgttttgattaaaatagagcc    251370
aagtgcattttgttttacatgttttactttatatttgttattattcttctaacaaacaaatacacatag   251440
tgatagttaattcttccatgatgtttttgaaaatgtgttgttctgcattggctataagtctcctctctga   251510
ctttgaagaccttggaaagctgccaaatatctcagaacttgttatcttgagtcttaaagtgaataaaatg   251580
acctcagtactacctgcccttataaaatgctctgccaattaatgcatacagtatgcatatactttgaacca  251650
agtatgttttgagactgcaggtttggatgttattggaatacacttgactctatatttctttttatggaaa   251720
cagatatacacacttaatgtcaaatagtttggatcttttatgagctaatatgattagctaatgtgatta    251790
gtagaataagcagtctcttttccatcctagtttgtgtcgccttctcctagaactcaacacaaaatgag     251860
cttcatgattcacatttatgctaacatggagacagaaccaccttgtgcaaaacaggtaaaagcaggtata   251930
agatgccataaagggaaatgagactgaatgtgttcaatttcgctttgtttggcttatcatgtatcataga   252000
aatgtgctcctacatgcagtagaaacaaaaacatcccttaacactctgtttgagcagttcaaaatcatat   252070
tttttatgttgtgcgagtttcaggtgataaatcctcttcaagatacatcaggggttcacaaaaatgtaaa   252140
aaatatgttcaaagtttgaactgactcatattttagcattcatggcaaagaactgcttttctagccttta  252210
ataggttttcaaatggactttgatgtgttagtaaatcagaattagctttttctttttaagctcctgtgtc  252280
ttatgtaaatggctgtgttgactttttaaggaattgaatattccagaaaatgtcatggaacctaaaacaac  252350
gtaacattctgattttagatcttaaagggatatggtgttaaatatagcttttgatacccatccaacctg    252420
tgcaaagttttctctgtacatgtgactttcaaatttgagaatttagtatgtcagtgaagggaaatctgta   252490
tacctgctgaaaacaaaatagaaatagaaattctgaaggaattattgtaatttacttaaataagaactgt   252560
aagtagtcaaagactattagtggaatgacaatagatttctttgagaccttcaaaaccttttactacca    252630
aaacagctgttatattctgaaaggcagtctctcttacaaaaagcattatccagaactttaacttatttt    252700
cacaaagaacattctacaaaattagtgtaccttgtttaaaaataagattctcctacctgaggtctgaaa    252770
tttattattaatgtgaatattttaagcatttttagaagaaaataattttgtaaagatgtaagttatgaa    252840
aaatacacagtgaagtacaacattcacaaacttactggaaccttgcctaaaaatgaactaattattgg     252910
atcatatggcaaactggttaagaaggataagaaattacttttatatcattaaaaaccatatgactatccac  252980
ctgcgcttctaaaacttttcctgttacgttctgctatttacttagaattttgtccattacactatta     253050
ttttaggttaaggaacaatgtgtttagacagttgctcattaaagtactaaacagaaaaggtagtagatta  253120
agcttttcacccacaatttatatattatcttataatgtgtgagagacaacagcataataaagataaattc   253190
ttcatcagtcttagtaacaatagggcactttttgcttttatgcctctcatttttatttaaattccttgtg   253260
aaattatgtaagttctttgaaatattgcttaaaatatatttagtttttaacatattttaaaaatatgga   253330
aatgtataacatgtgaaatttccctatcagcgtttcctgtatattttctccagctttgtcttgaattaca   253400
gacagatattgtacaactataccacccacccacacaaatttattcatttacacatatttcttttagtgc   253470
tgttttgcaaaattgggatattaattatacttctctgcaacttgctttacttactatttttattttttc   253540
tatcttttgcagctttgtgataatcccaagcattaagacacattataatgtcagtggaataaattagac   253610
```

FIGURE 11A-50

```
aatacagtgccaattaactaaggtttccagaggcaactcttttttgttattgatacaatgcaaatacaagt        253680
ttttcatgcagggctgccagggccctggagtagaaatctaaatcataaccaaaacaaacattatcaccac        253750
atagaaagtaacaaaaaacattttcatgtgggtttggagtatttgaataatattttaataattaggttta        253820
aagcagaaactgacagctttgtctacttcacccatcctgtggtgtcagatgcaggttatggatctggctg        253890
acagggaaattgaggtaggaaaataaaataaacaaaatgatattatgtacctgtgctttggtttaaggat        253960
gataaaattatttaaccttatgtccacattcctggagtggttccttaccoctacctaagaaaatccacct        254030
cttacttcttcaactgttcagatctcaatcaacacagctttttgtcattagcatgctggaaatgcattgt        254100
tttcatgaaatgaattactagttacatcaaaatgaatattagcatgaactctcattggcccataatgtta        254170
aaatattcaaatatatgaattggctaaaataatttacagaaaatccctacagtggcattatcaaggtac        254240
aaaaatccagaggtgtctttgcctttgacctggtccaatgcccatggcttgaagtctctttagccctaca        254310
ttcagatgttgacacaggagaatttctcattacctgatgctgactgaaaaagataaaagaacatcactta        254380
ttttgtccttagaggactgaaaggcagagaagctacaaatagaagttgtacctcaaaattttgaaacaa        254450
tacatatgaactgttttgcatctgctgtgggggtctgatgaatgacaatgtatgtaacacatttggctct        254520
gagacacacaggatgaaatataggtggagagaaggaattaataaccatcactcatctccttttttctgagg        254590
ttacttttacctaccaaaatgaacctaaaaattttacctgaacaaattggctcagatagattgcaacatt        254660
gactttattgtttgtcctagggctgccccctgggctgaacctaatgaaactcaggcgggttatatgaaaac        254730
tgcaatagcctgtatctctacactttctgcaacctggtttctgcacagagaaatgctgcatgtgtttgct        254800
gtaggcaaatcttaaataaaccatgacccccacaagaagaagagaatgatgtgcagaaatactttagggaa        254870
gggataagatggcaattttgaatgggagcccacagggtacaagtactcatattccattaccaacttcaga        254940
agcttaattactttggaaaaccattttttcaccttattttagtaatatgtcaagcatttcaggtggtctgc        255010
aaaagccgtatagccatggtcttagcctacctcgtcaaacatcaggcagaaacactttctaaacccatt        255080
aaaaagagtcaagcaggaaattgtgagtatatagtattaaggagatggacttgctattcttaaatttata        255150
gaaaaaaaaattctgtattttcttcgtcaatctccacttaatgacagatttgttttttataaaagatgc        255220
atgacagataatacttatttaaacttacagcggtaaacacgatgaaatattcttgttttttatccagacat        255290
ctgtaagaatttcagaatttaccocttgacaaattcatgtatgactttttttgtggaaatcttcaactt        255360
ttgttctcactgctccctgtcttcccccaccaacaaaccctgaatacgtgggaatttctcacaagctatt        255430
atttaactgcattccacatgtccatcagatgtcctacacaagatgggttaaatcaaagcttttttctttgt        255500
gggagaagataacaactgttttatattaaatgcataaaaattttttctcaatactacagggtgataaagac        255570
aagaaaaggccactttaaaagggagccatttgaaaaaataaaataaggcagaaatgcttcactttcctac        255640
ccaatatggaaataattttgcaaaaactaaactctaatgatggaattaaattatttatattgagtaaa        255710
agttacgttatgcatgaagcaacataaaaattttggacaacaaagagtgattcaggacaacatagtcac        255780
tactgctcttggtgtggttttttaggggggttgcataattggtgagttccttaccatcacctcacctgggaa        255850
gagaaaggggtcagggaactccatcccctacccaagggaagccctgaggagtgtgctgtgaggaacactg        255920
cactccagcccagatactaagcttttcctatggtctttgcaagcccatacttagggagattccctaagt        255990
tcccacaggggcctaggtttcaagcaaaaaactgggcagccatttgggcagacacccaagctagcagcag        256060
gattttttttttcatacccaggtggcaccctaggaccccattgagacagaaccatttactctcctggaaag        256130
agggctgaagccagggagccaagtagtgtagctcagcagatcacacccacagagcccagcaagctaag        256200
atccactgacttgaaaattctcactaccagcacagaagcctgaagccaacctgggatgctgtggcttggtg        256270
tggggagggcgcctgccattactgaggcttgagtaggcgggttttcccctcacagtgtaaacaaagcctc        256340
tggacagttagaactcatcggagtccaccccacagctgggcaaaaccactgtagccagactgcctctctat        256410
attcctcctctctgggcagggcaactgtgaaaagaaggcagcaaacccagtcaggggactatagataaaa        256480
ctgccatctccctgggatagagcacctagggaaagggacagcagtgggcacagctttagcagacttgaac        256550
attcctgcctgctggctctgaagagagcagtggatctgccagcacagcgttcaagctctgctaagcaaca        256620
gactacctcctcaagtgggtccctgaccccccaggcctcttgactgggagcacctccaagtacagtttga        256690
caaacacctcacacaggagagatctaactggcatctggtggttgccctctgtgacaaagctcccagagg        256760
aaggaagaggcaacaatctttgctgtgctgcagcctccaccagtgatacccacgcaaacagggactggag        256830
tggacctccagcacgccccagcagacctgcaacagagggacatgactggtagaagaaaacctaacaaaca        256900
gaaaggaataccatccaccaccaacaaaaaggacacccacacaaaacctcatccaaaagtcaccaacatc        256970
aaaaaccaaaggtagataaattcctgaatttgaggaaaaaaaccagcgcaaaaagcctgaaaattccaaaac        257040
cagaatgcctcttcttctccaaaggatcacaacttctccaccagcaagagaacaaaaccggatggagaatg        257110
agtttgatgaactgaccaaagtaggcttcaggagctaggtaataataaactcttctgagctaaaggagca        257180
tgttctaatccaatgcaaagaagctgaggacattgaaaaaaggttagaggaattgctaactagaataacc        257250
agtatagaagaccataaaagaccctgatggagctgaaaaaccaacagcatgagaacttcgtgaagcataca        257320
caagtgtcaatagccaaattgatcatacaaaggaaaggatatcagagattgaagatcaacttaatgaaat        257390
aaagcataaagacaagattagaggaaaaaagaaggaaaatgaatgagcaaatcccccaagaaacataaga        257460
ccatgtgagaaggccaaacctacatttgcttggtgtacctgaaagtgacagcgagaatggaaccaagtgg        257530
gaaacactcttcagggtattatctaggagaacttcagcaacctagcaagacaggccaacattcaaattca        257600
ggaaatatagagatcaagatctccttgaaaaaaggaactccagacatataatcatcagattcaccaa        257670
ggttgaaatgaaggaagtaatgttaagggcagccagagagaaagtctgggttactcaaaaagggaagccc        257740
atcagacaaacagtggatctctatgcagaaacccctacaagccagaactggcttgtagggtttattcaaca        257810
ttcttaaagaaaagaattttcaacccagaatttcttatccaaccaaagtaatctacataagtgaatgaga        257880
aataaaattccttacagacaagcaaatgctgagcgatttttgtcaccaccaggtctgccttacaagagcac        257950
ctgaaggaagcactaaataaggagaggaaaaaccagtactagccactgcagaaacataccaaaatataaa        258020
gtcctgagacactgtgaagaaacagcatgaactagcaaaataagcagctagcatcataaggacaggatca        258090
gattcacagataactatattaacttaaatgtaaacaggctaaatgccccaactaagatacacagactgg        258160
caaattggataaaaaatcaagacctatccggtgtgctatattcaggagacccatctcatgagcaaagata        258230
acatataggctcacaataaaggggatggagggaaaccaatgagaatgctgacaatgtaccagaatctctg        258300
atctctgggacacaactaaagcattgtatagagggggaaatttataccactaaatacccgcagtagaaagtg        258370
ggaaaggtctaaagtcaacaacctaacatcacaattgaaagaactaaagaaacaagagcaagcaaattca        258440
aaagctagcagaagacaagaaatagctaagatcacggcagaactaaaggagatagagacatgaaaaaccc        258510
ttcaaaatatcaatgaatccaggagctgatatttgacaagattatcaaaatagatagactgctagctaga        258580
ctaatgaagaagaaaatagaagaattaaatagacacagtaaaagtaataaaagggacatcaccactga        258650
tcccaaagaaataccaactaccatctgagaatactataaacagctctacacaaatgaactaaaacatcta        258720
```

FIGURE 11A-51

```
caagaaattgataaattcctggacacacacatcctcctgagactaaaccaggaagaagttgaatccctga       258790
atagaccaataaaaagttctgaagttgaggcagtaattactagcctaccaaccaaaaacggcacagaatc       258860
aggcagattcacagtcgaattctaccagaggtacaaagggtagctggtaccactacttctaaaactatta       258930
caaacaatagaaaagagggattcatccctaactcattatatgaggccagcatcatcctgatattaaatc       259000
ctgacagagacacaacaaaaaaataaaaatagaatttcaggccaatatccctgatgaacatcgatgcaaa       259070
aatcattaattaaaatactggcaaaccgaatccagcagcccttacaaagcttatccatgatgatcaagt       259140
ctggttcatccctgagatgcaaggctgatttaacaagggcaaatcaataacataatccattgcataaaca       259210
gaaccaaagacaaaaaccacatgatatctctatagatgcagaaaaggccttcggtaaaaattcaacatcc       259280
ttttatgctaaaaattctcaaaaaattaggtattgatggaatatatctcaaaatattaagagatatttat       259350
gacaaacccacaccaatatcatactgaatgggcaaaagatggaagcatttcatttgataactggcacaa       259420
gacaaagatgccctctctcaaaactcctattcaacataatattggaagttctggccatggcaatcaagca       259490
agagaaagaaataaaggatattcaaataggaagagaggaagtcaaattgtctctgtttgcagatgacatg       259560
attgtatatttagaaaaacccatcatctgagccccaaatctccttaagccaataagtaacttcagcaaag       259630
tctgaggatacaaaatcaatgtgcaaaaaatcacaaacattcctgcacaccaattgtagacaaacagaga       259700
gccaaatcatgagtgaactcccattcacaattgctgcaaaggaataaaatacctgggaataaaacttaa       259770
aagggatgtgaaggacctcttcaaggagaactgcaaaccactgctcaagggaacaagagaggacacaaac       259840
aaatgaaaaacatcccatgctcatggataggaagaatcaatattgtggaattggccatactgcacaaag       259910
taattcctagattcagtcctctcccgtcaagctaccactgactttcttcacagaattagaaaaaaaaaa       259980
ctaccttaaatttcataaggaaacaaaaatgagcccatatatacaatcctaagcagaaaaaaaatagctg       260050
caggcatcacctttaccctgacttcaaactatagtacaaggccatagtaaccaaaacagcatggttctcata       260120
ccaaaacagatgtatcgattagtggaacgaacagaggcctcagaaataatgccacacatctacaaccat       260190
ctgatctttgacaaacctgacaaaaacaagcaatgggaaaggatttcctaattaataaatggtgttggg       260260
aaaactggcaagccatatgcggaaaacagaaactgacccccttcttttacaccttttacaaaaattaactc       260330
aagatggagtaaagacttaaacatgagacttaaaacctcttttaaggacccacagcatttctgagcatca       260400
acacattcatcatcaacccaaaaccatggaggcagaaggagggaaagcatttgaaaaactagaagaaaat       260470
ctaggcagtaccatttaggacatagacatggacaaagaaatacttcatgactaaaacaccaaaagcaat       260540
ggcaacagaagccaaaattgacaactgggatctgattaaactaaaaagcttctgcacagcaaaaggaact       260610
attaccagagtgaacaggcaacctacagaacgggagaacaaatttgcaatctatccatttgccaagggc       260680
taatatccagaatctaaaaggaacttaaacaaatgtacacacacaaaaaaatcaaacaacccatcaaaaat       260750
tgggagaaggacatgaacagacacttctcaaaagaagacgtaagtgcagccaacaagcatatgaaaaaaa       260820
gctaatcatcacttgtcattagagaaatgcaaaccaaaaccacaatgagataccatctcatgccagttag       260890
aatggcaatcattaaaaagtcaggaaacaacaagttctggagaggatgtggagaagtaggaatgcttta       260960
cactgtttgtgggagtgtaaattagttcatccattgtggaagacaatgtggtgattcctcaaggatctgg       261030
aacaaaaaataccatttgacccagcaattccattactgggtatataccataaaggattataaatcattcta       261100
ccttaaagaacatgcacatgtatgtttattgtggccctgttcacaatagcaaacacttgaaccaacccac       261170
atgtccatcaatgatagactacttaaagaaatgtggcacatatacaccagggactactatgcagccataa       261240
aaaagatgagttcatgtcttttgcaggaacatggatgaagctgcaaactatgttctcagcaaactaacac       261310
aggagcagaaaccaaacactcttatgttctcagtcataagtgggagttgaacaaggagaacacatggaca       261380
caggaagggggaacatcacgcacccgggcttgtcagggcttagggggttaggggaggaatagcgtcaggaga       261450
aatacctatgtagatgatagcttgatggggtgcaagaaaccaccatggcacggtatatataccctctgtaac       261520
aagcctgcatattctgcacatgtatcccagaacttaaagtataagaaaaaaatatgtaaacaaattataa       261590
taggaaaatgtcatattcatattatgaatatgtacttcaaattagctgttgaataaaattaatgaagtca       261660
cttaaaaaataaaatgcaggttattctggagggtattaaatatttatcagtaactatcatttgttaaaaa       261730
ccaggtatccccaatatgttactggatgtgtgagaaagagttctggagacgtattttggggagtccact       261800
acaactgatgaatttcatctcttctttgtctctctgtctctgactctgacactctctgcctctcactgat       261870
tgcttctctctgtctttacatacacacacacacacaccatacacagaatatttcagaaattctcaaca       261940
cacaccaccagtaagtaatgccaacaattagattataaaactggcagtaattttctttcaatgcggcttt       262010
ctatttcattatgtcacaaataccaaagtaacaggtggacaatcaggatacattctgtcatgtttacatt       262080
atgtaataactaatctaaaacaaatgcccagtggaggtttcttagctttctgtcagttttcaaatgtt       262150
ttccctcttcctgcctccctggtctcaggttggcgatgcatgtgctggtgctcagagatgctatgggtcc       262220
ttagaaggggttttgagctgggcatagatgattatttccaaagcagtctgccaaaccctcagttcctgt       262290
aattctacacattttcaggcaatcgaaacaatgagaaagatagtttgggtggtctgcaaatgcaaac       262360
ttaggcagccacagtcctcaactagcaatactaatttttctcatccttttccatttctaccagtgtataat       262430
ttatataaatttcctctgcaaaccaaaaaatgaactattccttattttatgatgttatgaatgtgtctg       262500
tgtcttagactataactgttggcatagaaccagcttatgcttctataacttttgttgtatgatctttaa       262570
aattttgacttgctggtaaatataaatataaatatagaaataaatataaatataaatatatttgcctgag       262640
tgtcaaaattatatatataaaatgtatgcttgtgtatataacaaatattttatgtagattatata       262710
tataatgtaatgtaaaacatatatattacatcatatattacagattagctatatataacatatttgtttat       262780
atttatatttatatattatgtaatgtataatatatatttatataattatatatatataatttcattagt       262850
tgtatcattttctccagtttgatttccagtggtgcagaacattttattcatattcctgataccaggaaag       262920
ggtgcatattgacagtgcaactcaagtaaaatatttagaagacacatggctataattagttacttgcatt       262990
tttcctgaaagcttttcatggtattgcctatttaagaaatatcttgctttgctttctgaagcaaataaacta       263060
cactagcagcatttcttgaatctctttgatctgtgtggtgtgttggtgtggttttacacaggattttgcc       263130
tatttttttttaagtgtggatattcctcctttatctttttaacaaatattgaaatatttaaaattttta       263200
atactagtctcattaggaatgagagtttcctataattttcctggggtaatgttatacaattcatttctta       263270
aaaaaatacttcttaaattttgttaattgtctgattattttctgtcattttttggcactttgtattgt       263340
tacattatgattccatatcctccttttgattccagcactgagaattggttttcatttctatgaactcatta       263410
ctgaggtccttgtttcttttgagatattaaacttgacctgatttttttcttccctgtgagagtggaaa       263480
ttatcattcttttctactggttcagcaaaaagaaatgctacttcctaaagaatatatttttctatgat       263550
taaatatgttttagataaaacaaaagctttttacatctgtccataaagtgtaggttttgaaattctcatt       263620
ggtgatagctatgtttattttcttacctgacacatcagctaccacagttaaattcggtgaactattctg       263690
tatcacttactgatgaagaaataaatggctgtctcatgttggtaagtgtattgctgttccacaatctgaa       263760
tatattttgcttaaaccttgaggtgttaccacatggtaaggatttaaaatcacactcagatcataatag       263830
```

FIGURE 11A-52

```
tagttatctactttcaatgttgtaaagtcagatataccattgcaagtttaaaaacagagagtactttgta    263900
gtttaagtatctgatttaccttgataaacactttcatcaattttgagagcatatacaagctatattctgc    263970
tcttaaattttcaaggtttgggggtgtggggagagtgggaaggggaaggaggagagggtgagtgtgagg    264040
ggggaagagggagggaggaagagaggaagagagagagatagacagagagagagacagagagagaaattgc    264110
cgtggttcatggagccatctagctacaaatgtcagtttatgagaccagacacaatggctcatgcctgtaa    264180
tcccagcactttgggatgttgaggcaggaggaatacttgagcccaggagtttgagatcagattgggcaac    264250
atagtgagaccccatcttttcaaaaaataaaaaatataaaaaattattcaggtgtggtggtgcctgcctg    264320
tagtcccaactacttgagaggctaagcctgagggatcattgagccctggagttggaggttgcagtgagct    264390
atgattgcaccactgcattccagcctgggtgacagcacaaaacctgtctctgtataaataaataaataa    264460
ataaataaataaataaataaataactatgtatgttctttccagcttttcatagtcccccaaagcct    264530
tgcagccttccaaaacttgattttcttctaaatttctcagaaaattgaggggaaaatagcacttagaatt    264600
tgacgacagctgtctacatcacctggaatctctggcagaacaccaattcagtctcttctttgagcttcac    264670
aacgcaggcatatattacaatttattaggttgagcacatatggccttaccctcaggagttcctccata    264740
gttcctccatgctaatctccgtagagagaggcatttctccacttttattcaaattaacagcccataaaag    264810
aaaagcatcttaaaggctgcagcctctctgggacttgcatgggcgtctcctattattgtgcataatgc    264880
tgtgctgaaatacaggtcaaatactctaacatcctttgctcattatatgaacattatgcatattgcagt    264950
ttgaaactaggaagagagaagagcaatattacaggcgaacatgaatgcatcagaatatgataactttaaa    265020
ttagaagagaaggctctcaatttgaattctcagtgttctcttctaatacacacaatgatgtcttttcac    265090
atgattttaattttgattattatggataaataatagatgtatatatgtatgcagtgtttttcccacaggtg    265160
tgaaatgtgtaataatcaagtcacagtagttgcagcatttattacggcaggtatttattccttctctgtg    265230
ttaagagcattccagctctactctttagttattttaaaatacacaacaaattatttttattgaatcactc    265300
tgctatgctaccaaatagtagatttttttctttttgagacaggtgcttgtcgcccaggctggag    265370
tgcagttttgtgatcttagctcactgccacctcgatctcctgggctcaagcaatccttccaccttagcct    265440
cctgagtagctgaggtgacaggcccatgacaccatgcccagctaattagtatcattttaatttgtaca    265510
gatgaggtctcactgtgttgcccaggctggtctcaaattcctgagctcaaatgatcctcctgccttgatc    265580
tcccaatatgctcatatttcagatgtgaaactctgcccagctgataggaatctttcatagagtttcccaa    265650
taactgagctttcaaagatttggatagcgactgagatagtgcaaagatctctcaaataacaagtctga    265720
ccagggaccttgtgttacttatatgaatacactgaggttgctgtctgtctctttgttaatgtataagcag    265790
agaatggtatattgatgcttatcagattttcagtttaatattgaagcattacaaattaaaatataaggtg    265860
tgggatacatgcaatttttactttaggggtatgcaaaacctgagggccccaaagcagaagaaggcattca    265930
gcccctactctgcatttcctccctcctgagttgccagccagccagccagcctgtcttacagattccagac    266000
ttgccagttcccagattgcgtgagtcaattccttaaaatagatcgatctaataaatttatcctatattgg    266070
tgaacaaatttagcacagaactttgatatatattagtaccacttattattttttagaaaagttggaatttg    266140
aataacttataccaaagtttaattcgtcatctggtgtgtatgttataaatgcacacccactcacagagac    266210
ctattcatggcctcacataaaaataggcaatagatacaggaaaagacaggcagccatagaaggtcttaga    266280
taagaaacccccatccttcgcacactcactcaagaacgttgttcccaacttctacatctttgtagtttat    266350
atccactgggcaccccctaacatccatccacattctttcatttatcccatttggaaataagcatctgacct    266420
gcactttctctgcctgatgtggctgtatgtcttgtttctctagcaaccatctgctcgtcttccaagagt    266490
cctcactgatcacatctcaactcctcttcacctatccttcttaaatccactccacttcaccaaactcct    266560
cttgccaattatacaattggatcttaggccccacaaaagtggagctactattcctaatgttcctaaaaaa    266630
tgaccattctgcattttccctccaatctccactgcctctattttggaaaaaatttcatctttgaaaaa    266700
gcatttaagaccaactttttttcccactctggtgggaaaagaaatattgctgaatgcagaggacaactac    266770
atgaattcatactacttgctctggcaatattcccagatcctatcctggagcatttggtggtagttgggag    266840
gatggattttctagcagtatatagactgaatgtgtatgtccccaaaaattcatatgttgaaacctagtc    266910
ctcaactgtgtaggtatttggaagtggggctttggaggtaataaggccatgagagtggagcccatgag    266980
tggaattcctaccattacaaaagggtccccagaattcctaccattacaaaaggcgccattgcaaaagaca    267050
ccctcatcccttttaccatgtgaggacacagcgagaaggtgctgtctatgacccagaaagtgagtcctca    267120
ccagccactgaatctgccttgatcttggacttctgtgtccagaactgtgatcagtttttgttttttaa    267190
aaccatgggtacagtcttttgttttagcagccaaagcaggtaagataggtgatgctggaaagtaatggag    267260
atgtccacaaacaccctgaatcatgtactgcttcccaaccccctgtcctcctagcagagacagcaggaaa    267330
aagaaggcttacttcctccagatttgatgctcttctacccacagtaatgacagacaggttgccttatatt    267400
tttattgtgtttggttcatctgatcaattcacaaattgctcaaatgtcagaaaaatgggtcaaagggcca    267470
gtttggatttctgtggtagaaaaagaaaatgcaaaagactagctcctggtgtattcctagactgtaagaa    267540
agttcttattttacaaagccataaataaatatgacatttctggtgcctgagaatttgaggcaggtagtac    267610
tcccgtgaagtaagataatgtcttatgtaaaataataaattcattcaaaaccatgggaatcattgtaact    267680
ttcattgtcaagaaagaaacataattttggatgtaggtgaacactaattattaaagatgattgttctc    267750
agaacaagtttattccgatttgtagctacagcaatctaagagaaagcaatacagcaaccaccaaccaata    267820
tgaggcttcttataatcatgttgggtgggatgcttcttctctgtcctacatcctgagaatgactgaag    267890
gtttcctcctgtcatgcgatcttcccttcatttgctatattctagatttgctagtctagtgcactcactc    267960
caggaactctgtacttgtactcagcatttactgggtggtgtatatctgtcacaggttataagtttcatga    268030
aaagcatgtatcatgcctcccttttcctcatgcacgcatgcagcaagccaattaagggcataaaacaca    268100
gcacataaagccctccattgattgacttaaattaatttatgaacagttgcaagggtaactgagggcccac    268170
atggttttcatgtatcatttaaaaaaatttttaaataatgtgatttgatttttttatctatattcttattct    268240
atagaaattaatctatcatatttcaatagtaacatggttgacattgaggtttaatataatatgttggaac    268310
acacatgataccttgattctgaatcaacactgtatgtgcaatttgatgtctgatgtatgatttggggcag    268380
tttgaagaccagacatttctttgtactgagcctctcccattccctgtgtgtgaagggaaccgtgggaata    268450
aatcagtcttcaatggatggaataggacagttgcctttgtccctgaagtgttcaactgatcacagcagtct    268520
gttttctgagtcaagatgcaacttcccctgatgtaggacactacatatagtgtagtgtgtgctattccat    268590
atctattggaatcatcacacatgatcagtcaggtttaatgtcaagtcaggttaatgtcaagggtgtgat    268660
agatagaaatggatgcagatagtcttgcaaatttagttgaaccctctcccagcatcttctgctggcctca    268730
gtgactatcttcttgaatagaatgttctgggagtaatgatttgggacttccaaggatggattataaggaa    268800
ctattaagcttccatttaggacatttggagtgctgattcttgtgacatttccttttggaacccatacctc    268870
atgctgcaagtgttcaagcccatggagaagctatgcatggtgctccaatcagtagctttgcttcattt    268940
```

FIGURE 11A-53

```
ccagttgacaaccagcagtgccaccatgtgagtgacccattaaggacatcccatctgattgagaactcct      269010
atccccttagctaactcaggaactctcaagagagaacttctcagctaatcccagtcaactcacagaattat    269080
gggagatcctcataaaagagtgtttgaagccatacattatgggcatgtttgttacacagcaatagctaac     269150
cattgttacacagcaatagctaaccagagcaggcattgaaaccagaagtgaggatctcttttcaacagaaa    269220
cctaaagtaagtggtgttggatttgaggccaaatggtatatggaagctagaacctccatggggcgagaca     269290
aagggcttaaagaacaaggaaagaaaattggaggctgggcattggaactgatgaagagaactctttgaa      269360
tgactgactcacaacagtgagcacttttctcactattggtgagagaagtaaccttttgcattgtgcaact     269430
gcatgcaaactggattttgtcttttgaaatagaaagatgtgcatctcaacacatttgtcatgtgttcc       269500
taataagcttaatacttaacataaagttcacaggcctgtgttatttataatcttagtatagtatagttta    269570
cactggatggcaaaaggtcacatatacaatgacaataatagattcttttaaaatttattttggttacact    269640
taaatgtaaattgtgaacatcatttctattttctattataccccatggcttttctattgtttgagtcata    269710
ctaagtctattttttattgcataaatttttgcaacatatattctaacaggaaaaataaaattataaaacata  269780
tgttttatatatgtctttcctttaaacgtgagattttaactaggttttcttcttctctgttactatgcat    269850
atgtcttttattctttggatcaatatattcccacatcccctggaacatttttttggaaagttggcagtgc    269920
tcctataaaattctttttagtctctatctgcctgacatatatttaggttccatatatatttatcattttct   269990
acttaaatatacatatttccattttatgctcatgctattctgcaaatgtctgattttaaggatgagac      270060
atgcatttaaaaaggacatctgtatcttctttcagaatatttttttccttaatatgtgttactttcatatt   270130
tgaaatttcataccccacaaacatacacatacaaacatgtgtgcataatatacatctcacagaaatatcca   270200
ccactttgggaaaatgtcatttctgttgaaaatgtctttacagccacaaaatatatattattctttggcc    270270
taagccacagatcctctgtcaccactatcaattcatcccagggtctaatcacttgaaattaatattgtt     270340
tctttgaagaatttcagaattaatttttttcctcaaaatttcatgaacttgcatgcattttttacctcag    270410
accttgaacactctggacaaattcctttatccctgtaaattttttaactaattctaaacaaaataccttt    270480
gttcacttttcccctaaatttgctaacttctcatgcattttgttttgtgacttgaaaatgctctggaaaca   270550
cttctttatgcccatgattcttttaattctaaacaagctactttttatcaatgctgacaaggtgtagagaa   270620
taggaaatccttataccatattggtgggagtgtaaattctttcaactattgtggaatgccgtgtgataat    270690
tccttaaagagctaaaagcagaaataccatttaacccagcaatcccataactgtgtatatacccaaacaa    270760
ttagaaattgtatcaaaaagacacatgcggccgggcgcggtggctcacgcctgtaatcccagcactttgg    270830
gaggccgaggcgggcggatcacgaggtcaggagatcgagaccatcttggctaacacggtgaaaccccgtc    270900
tctactaaaaatacaaaaaattagccgggcgtgttggcgggcgcctgtagtcccagctacttgggaggct    270970
gaggcaggagaatggcgtgaacccgggaggcggagcttgcagtgagccgagattgcgccaccgcactcca    271040
acctgggagacacagcgagaatccgtctcaaaaaaaaaaaaaaaagacacatgcatgcatatgtttatt     271110
gtagcactattcacaatagctaagacatggaatcaacatatatgtccctcagtgtagactgaagaaaata    271180
tggtacatacataatggaataatatgcagccataaaaaagaacaagatcatgtccttgtcaggaacat      271250
ggatgaagctgcaggccattatccttagccaacaaatgcaggaacagagaaccaaatactgcttttctc     271320
acttgcaagtgggagctaaagatgaaacacatgggcacagagcagagcataatagacattgtgacctat     271390
aacagggcagagggtggggagagggagaggataaggaaaaataagtatcagtgtactagtcttagtacct    271460
gtgccatgaaataatctgtttaacaaaccctatgacagtagtttacctatataacaaacctgcacacat     271530
atccttgcacctaaaataaaagtttaaaaaaataccagcatccactacatgtatggacagtttttcttggg  271600
tttcacctcagaaaacactgctaaaattcaagtataaaattactttgattacatgggttaataatagctct   271670
ctgtgtgtgtcttagtcccctctctgtttcctatgtgtattacttgatttctaaataaactgtagaagct    271740
ccaagtactatttgaatctctacatacaatggtgccatgttatctaattttttcctttaggatgtgtaca    271810
aagactgtacaaaatatttgaattgtgtaatggtatccagtatggataataaaggataagtaaattttg     271880
agaagtcagttaagtccgggcgcggtggctcacgcctgtaatcccagcagtttgggaggccaagcgagcg    271950
aatcacgaggtcaggagatcgagaccattctggctaacacggtgaaaccccgtctctactaaaaatacaa    272020
aacattagccgggcgctgtggcggctgcctgtagtcccagctactcaggaggctgaagcaggagaatggc    272090
gtgaacctgggaggcggagctgtagtgagctgagatcgcaccgctgctctccagcctgggcgacagagc     272160
gagactccgtctcaaaaaaaaaaaaaaaaaagtcaaaaataacagatgctggtgaggttgcaaa          272230
gaaaagagaacacttacacaatatcggagagagtgtaaattaaatcaatcattgtggaaagcagtatagt    272300
gactcctcaaagagctaaaaacggaaccaaaaagaaaaaaagaaaaaaagaaatttcagttgaaatgta     272370
atagatacatagatgtctaatttttcagttctgaactatggacattttttgcaaagatacatgcttttcac   272440
ttcaggaggtatttgtcaagtctgaaaaaatttggctgccacagctagattatgggagtgagtacca       272510
ctcgcatttcaaggccagaggccagagatactgttaagccacccacaaggcataggatagcccagcacat    272580
taaataatcttccatctacacatgtcaatattcctgaggttgaaaaccagatctagagtaattaatgat     272650
gagcagtaagtataggccgaagcctcgttttccatatgctgtgatagattttttaaaatagtcattgga     272720
agaaataaaccctcggttctatggaagtcataaggaatattctgcctgtgtgcttgtacaaccttggctt    272790
ggagcagcggtggatataatgcaagtggctttgcagaatcacgggtttttctacaggtcatttcatccc     272860
caggtattaagctgagtactcattagttatttttcctgatactctccctgctcccaccttccaccctcaa    272930
ggaggtctcagtgtgtgttactctcctctatgtgtctgtgttcctggtgctcctttagctcccacttataag  273000
taaagacattcagtatttgctccagatagttgctggaggctattatccttacaatcttctatattaatta    273070
caatgggcatctcctgaatttcagaggaatacttgtttcctgattcctgatgtatatactatcagcata     273140
tacataaatacataaatacatggctgtgaaatcacataaagcctttacttccatacttgacttcctgcag    273210
aacctccacatttcttatgagcttccatttttctttcttcttggcatttatcattacttaatgagaggtt    273280
tccaaagtttagagtagtacattaattaccatttctcctcttcctcctgctcctcctcctcctcctcctc   273350
ctcctcttcccttttccccttactctctttctccccaccttctcctctttcttcctcttcttccttcatt    273420
atttatttatttatttatttctgagacagcattttgctctttcacccaggctagaatgcagtgaca        273490
ccatcatagcacagtgcagcctcaacctcctaggctcaagcaatcctcctgtcttggcccccaaagtgc     273560
tgggaataccaggcatgtgccacatgccagactactttttattttattatctttttttaagagacagtc     273630
gtgctctcttgaccacgctgttttgaactcctgggcctgaccagtcctccttccttgacctcccaaat      273700
gctgagattacaagcatgagtcaccatgcctggccttaaattgtgtatcttctaattgatgtagacttt     273770
atgccctatttatttgtgctttgaagtgaactgattctgaatgtcagtgctagagcactgcttagtgttt    273840
gggggtggttaggcagatatgcaagttcttagagcataaagctgctcactgctcccagtagagggctgc    273910
aactgtttggagggttttagaatactaccatttgtgagttatgtatgaagttagggaagcctgctactcc    273980
tgattagactggcaacaacttttttgcattataagacaactgaaatttcatgtccaagccaggtgatctga   274050
```

```
gctaccoctgttcattccagatccagggctggtgaggcaaaatggtatccccaaaacagatgggtctctt       274120
tactgaacttctgggttatctccaccatgtagagaagatatagaatcatgcatttataaactgtatggtt      274190
gaagatggcacccacagttacattttctcccaaacttccccggcctatctcagttcttagatatattgt       274260
ctgaggattcctgattaggcatagagtaatgaggaaattttctccttagatgattatggcaagctgctat      274330
aggcctgttatttatcctcagttaatatggatattctagtaggagggcacagtaaggtaggaagaaatgg     274400
tcactctgaattcaaagtatctcttaatttagaaggcaagtttaccactctgaaagtactgagagtctca     274470
aatttcacgtaagcatattttgagcatttctacaaatcctcatttcttcaaatcccatcctttgcaac       274540
ctcaagtttatccggaggattcacactgcctgcaagtccttcttgtatgcatttcttgttgtttctgtaa    274610
caaattatctcacctgtagtggcttaaaacacacacatttattatatcgccattgtgaagttctgtagtc    274680
tgagtagcttggatggtttctcttcattgtcgaccaaggctgaattcagtgtgttggcagcagggtagtg    274750
tttcttcctccatattccagggatgcgttcacttccagaaacatctgggttgttggctacattcagttcc    274820
atcaggttgcgggtcctgcttccttgcaggctattgattggctgagggcaaattttggcttcttgaggat     274890
cgaagcattccatgactcctggcctccttcctcattcttcaaagcacagcttttaatgttctgaatctct     274960
ccaactaccttttctacctcttctgtcctttcccttgtcatatgcttgtctgacctgattgttctgtca    275030
ctgtttttcttggttttcagtatcatacaattgtattggacacatttggttattctaggataatcagctta  275100
tcttaacatcagctgactagtaaccttaattgtatctgcaaagaccattcataacagtacctagatacat   275170
gtttaacttaatagcgaggggaataagaatcttgagtggtgtctttataattctgtttaccacacaccca    275240
tccgggtggacagactccttacaactgggtttgagtactcagaacaatggccttccatctttactcaccc    275310
agggagctcctccagggaaagctcatctaagtaagatctcaccatcattttcatgcccttcttttttttt    275380
ttttttctttgttgttttgagacagagccttgttgtctctcccagactggagtgaagtgacatgatctcgg  275450
cccagtgctacctccacctcccaggttcaagcagttctgctgtttcagcctcctgagtagctgggactac   275520
aggagtgtgccaccacacctagctaattttgtacttttaggagagatgaggtttcgccatgttggtcag    275590
gctgatctcaaactcctaacctcaggtgatccacctgcctcagactaccaaagtttctgaaattatagtca  275660
tgagccactgtgcccagcctctcctgatcttttgaagtccaagtaataatcctcaggtggcagtgcacat   275730
aactgtggagaattaaccactcctctctgatgttgcttgtacccaccgcaaataatttgtctatttattt  275800
ttacttttattttcattttttgagacagggtctcactctgtcacccaggcttgagtgctgtggtgcaatt   275870
agagctcactgcagcctcgaccttcttggctcatgtgatcctcccacctcggcttcccaagtagctggga   275940
ctaaaggtgcatgccaccacccatggttaattttaattttttttcattgatacagaatcttgttcaggct    276010
tgtcttagaactttttaggctcaagcagttcttccatctcagactcccaaagtgagccactatgcctggcc  276080
tatttgtcctttttaattaaaagactcaacatgtagaaataatttatcccttcaccttgtgcattaag    276150
agcttccttttcttgcagatggctgaactgaagcaccataagtgatgagtgacattttgtatttttac     276220
acacattcctgcccttctcagatgagtctaggctttcatcagtatttaaatgctaacttactctggcaa    276290
gacatttaggtccagaaaatagtttaaaaaaataacatcttcacagaaagaacctccagatagttaaaaa    276360
taggggaacttgtggatacaccatattctgaacaattagtgttgctaaataaaccacattatttttaggtt   276430
tttcttcctgatttttttttcttccttgtgttactttaattctggaacataactgggcactgataatac    276500
tacagcagacccttatctcttttctttattatgactggaaatcgtaattagaaagatggataaaaatgga    276570
aaagcttaatgacgtatgcatatttttataagacagaaatatggaaagatacgagcaataaaataattca   276640
gtttagaataggaagggttataaaacacttttttaagcagaaaaggaatcagagaatggcactttataata  276710
tagtaattaagcctatttatttgataaaattcaaatgtcatgtcctctttgtacctatgagtgcacatta   276780
acagtaaccataaaaaaagaatacttggagctacagatatgtgtgtgtgtgtgtgcatctgcacctgtgtc  276850
tttgggtgtgttccatctgatttgatttttcaccatatctctattttgcactcccaaatgtaagtattt    276920
aagtgtttattatataaaatattttgcattcttcctcccttcacatgcagtgatttacaaatttcctat    276990
ctgactattccatcctgcaaaccccccagaatactgtggctgaggtactcctcttctgttcccttctct    277060
atataggtggaacatcttctgggaaccatcttccatctataagtttcccattcacagaggtggctaaatc   277130
tgtagcatgcatccatccatatccaatagtgtcttttacatgggtgggttggataatgcaaaaccaagctt  277200
caacgtcaatggtgtgagaagtacacaaacacacacacacaaataaaaacatgcataatctctgtagatc   277270
agaaggggattgtccagagtaataattaatgtacactcttaactacaaagaggtcataacatccaaattc   277340
cgttaagtacattgactaaattactatattataaagctcccattctctaatatcttttgtgctaaaaata   277410
ttcccaagccatgttgaagatatctttcaacagttatgtttcctaaaaatatgcctagattgttaaatgt   277480
tcacttcttcatgtgttttttctggttacgattttcagtcataaagatgaaagtgacaagggtctcagcag  277550
tgttttacctctaaacctaatactgaccctaacagaaattgaaaccttaaaactaacctgtggcctttga    277620
ccattgcttcttgatcattgagctgacccatgaccctgaacagaatgagaacttgaacccaaatttta     277690
atctggaccctaactaatgactggatatgaaacctaattctacccaaccttgaaaatgaatctaaattta    277760
gactcaaaaccaaacccaaccccaacacctaactttaattcaatgtaaaattttgaactcaccccttgactt  277830
ttgccagtaacccttgactcttgacccctgatttgaacactgaaggcatctaccaaattctctaacccac   277900
agactttgatcctaatcctgacctttgaccattgtcctaataacgaatataatcccttgatcataata     277970
ttgacttgtgctcctaccctgacattcaattagtgatctaaccatacccaaattgaacttgaagccaaa    278040
tcctaacatgaaccttatcaatacctgaaacccgtcctaaccottgatctttgatctttaaccctctgt     278110
gttttgctccttgactcctgactgtgaataccagcctggactaaaatccaaacacaactcaacatcat     278180
tcttgaccagaattgttacccaaacctgaacaggaacccaaaccottacccctacccacttacaaatctga   278250
acacaaaacctctaccattctgaacttggggatttgagtgtctcggtcctgtttggtagatgcggagtt    278320
tgcaggccttcagtcatggtggacaccacagacttgaagaaactctccaatatatttttgggaaaaaa     278390
gatgcaaccatttgagagcaagatgttaaaacattcatcctcaatctctgtttgtacagacttcaaggtg   278460
aaatacatgtggttggacttgtgatatttccagccacaaatttgtatcatgtagagataatgtaggtttc   278530
cctgtctctgaaaatgcatttattcaaccagtacttacttgctccagaagtgcaccagggaccatttag    278600
gcccctggaggcagccataagcaaaacttcccagatccctacctatggaatctctgcctatggaatggac  278670
attgtcataatggatgtagataagaaatatcctggactcaaatctgaacttcagtcacgctggaagtcca  278740
aactcctgcccagacatgttttcctattactcacagaggataggtgaggactcaggttaattaaggtggt  278810
tattttgttgccagttttatctaatgtcctttgtggatgatgtgttttttcacttggaataccaacatga   278880
gagactgggccacttctcaattcagaaatccactcaaggccaggcatggtggctcacacttgtaatccca  278950
gcactttgggagccaaggtgagaggatcgcttgagcccaaagagttcgagcccatcctgggcaacctgact  279020
aaagcctgtctctacaaaaagaaaaaaaaattagctcagtctggtagcacatgcctgtagtcccagctac   279090
tcaggaggcttgaggtgggaggatccctaatcccaggatgtcaaggctgctgtgagctatgattgcacca   279160
```

FIGURE 11A-55

```
ttgcactccagcccaggaaattgatcctgtctccaaaaaaaaaaaaaaaaaaaaaaaaaaaaaaaaaaa    279230
aaaattcaactacatgtagaagagagagagtgtgtgtgtgtgtgtgtgtgtgtgtgtgtgtgtgtgtg    279300
ttcattagatttaactgaggatttaaggagaaatttggaggcatattctcatatgggaaaaataggaaaa   279370
taaaccttctaaaatcaacatctagcccttttgctgatgacctttggctatcctaacataaactttct    279440
tctgaatgcttcaaatctcaactcagcaaatccacaatgagctataggaaattcacgatctcttctttc    279510
tttggatttcacccgccgccattcatgatttaacaaataattctttgaaaggcagttctctttcaaagat   279580
gagtttgcttctctgtgttaaaataataaatatgtgtcgctgttaaaatagttttgcatacatgaggga   279650
actcctttagaagctttattgggtttcttagctgtgcatgcaatttgaataattactacatagcaattcc   279720
agtaacatagccaatacatcagaaccctcaggggaggcagccaggaactttcttgcaaaatatccccac    279790
atcttcatccctctctggagaccactggtaaaatttacaatcggtaataatttctacagacatggcaact   279860
gagaatggtagaacattagttttaaaaatcattttaataaaatggctttataaatattgagacttaatta   279930
tttaatttgttccagttaatgaaagatttcatttggcacaagactaggacaaattagaatacgtataatt   280000
ttcttcattccagacaaacaattatttaatgtctactggtacttagaccacaaacttaattcattgatt   280070
tcatagtattagaaaatatagagtgagaaaattgttagcagggcacagtggctcacgccggtaatcccag   280140
cagttgggaggccgagacgggcagatcacaaggtcaggaaatcgagaccaccctggctaacacggtgaa   280210
acctcgactctactaaaaaaacaaacagagaaaaaaatatatagccggggtggtggtgcactcctgta   280280
atcccagttgctcaggaggctgagtcagaagaatggcctgaacccgggaggtggaccttgcagtgagcag   280350
agatcatgctgcttcccgcagtctgggtgacagagcgagacccatctcaaaaaaaaaaaaaaaaaaa    280420
aaaagttagaagttgttgaacagctggattgacctaaaattcaagaatgtcattttttatgc           280490
ctcaagctgttttgtgcagttctattttcaacttccatagacaattgtaatctttttattttgttttctt   280560
attagagaatgtttcatgatatggatgtgaataattaaatgaacatctttctatgtacagcttgaattta   280630
aattagaacatgatggagatttttggattcccttaattcctgttataaattgtatttctttaaacctgc   280700
ccaaagggtaaccatctttctgaaaccaattcattatttccttcttttactaaattttatttctacaaaa   280770
ttagcactaccagcttaacctaaagaatatattgtcatctgcttttgttcttttataaatgtcattctgt   280840
gtttttcttgacctagcacttccttttttcattgaatggtatgttttgatattcaaccatgaaaattctt   280910
ggagctgtagttcatttatgttcactgatatgagaaaccacaccctatggttattccacaagatatttaa   280980
ctctttcagaagctgggtatttgaattggccttatgtaaacagttcaactgttagtattctgtgtatatc   281050
ttgttgaaaaaaaatgaagtttctctacctagaaatagatttactggactatatttttatatccatattta   281120
gatatgcatcctgatgtcaagaactgtttaagtggttgaacagttttatttacccaagaaccatatgaaa   281190
gtttcttgttcttacgttcactatactgagtccaaagttgaatagaaatgaaattagctatctttgattt   281260
gttctgtctttagacaaaaggagttttaaaaaaaattttatttgagacagtcttactctgttgccctgg   281330
ctagagtgcagcggcatgatcttgtctcactgcaacctctgcttccggggttcaagcgattctcatgcct   281400
cagcccctgagtagctgccactacaggcgttcactaccatgcctggcaaattttttgtattttcagtaga   281470
gatgggctttcaccatgttggccaggctgtctcgatttcctgacctgaggtgatctgcctacttcagcc   281540
tccaaaagttctgggatcacaggtatgagccactgcatccagccagacagaagtcttctaatgttttatc   281610
attatgtataatatttggagtaggatataaatgaactatctttttcacataaataaatgtttatctcctt   281680
aatttgataacatgaaaccataaattcattagaggtaattttttttttcatcttttaatattttccttgct   281750
ttgtgtttaattgttcatgtagtaaattaaataagttaacttctaatatcaagcttagtttgatattc    281820
agtatactcttaatatcattttgtatttgttatataattaattcatttttgtatctctgtactaaattgg   281890
ataggctgtaattttccttatgttaggcttctctggttttagcctcaacttaatagtagctgtgtagaaa   281960
tagtaagaaaacatttctgctctctgggagagttcatataaaaaattccttaattaataggtggtagact   282030
tgctattcagtccaccctggacagatgatgtctttgatgtagttaaaaacatcttttatttcctgcttga   282100
tttgtgggcttattacgtattgatttcttatatatattaataacaacatgtttgcctgtatctgtctgt   282170
taacactttattatgttctctttttccatttgtctgttgtctgtatacattttgttaaactattgtaaca   282240
aattatgagaaatgtagtaatgtaaaagagcaaccatgtagtatgtcatggttctaaaggtcagaattct   282310
tggtgcagtggagcctagcttggtcctcttcttaaggtcttccatgggtgaaatcaagagactggcaggg   282380
ctgtattcctctctgggggctggagggatgaatcgttacaacatgtagattttaaaatctaagtattt    282450
gcactaacttctgattttaccatattagatccataggtgaattcctatttcttgatcatttgagtctta   282520
gagaagcttgatttccgtcctacaacatcgttagattattacagatttcttactctgctttaaacaagggg   282590
ttttctctgtttttttgtcaagattaacataatatatttcaacatgtattatacttgagttgtatattgtg   282660
agtatataagtacacacaatgaacgactcttcagcctttaaaaaggagtaaataagaaataggccggacg   282730
cggtggctcacgcctgtaatcccagcactttgggaggccgaggcgggcggatcacgaggtcaggagatcg   282800
agaccatcctggctaacacagtgaaaccccgtgtctactaaaaatacaaaaaattagccgggtgaggtg   282870
gcgggcgcctgtagtcccagctacgcgggaggctgaggcaggagaatggcgtgaacccagaggcggag   282940
cttgcagcgagccgtgatggcgccactgcgaggctccatctaaaaaaaaaaaaaaaaaaagaaagaaa   283010
tcatgtaattggtgacaacacagatgtacctgaaggacattatgtgaagtgaaatgagccaggcacataa   283080
aaacaaacactgcatgatgaaatgtgaaatctaaagaagtcaaactcacagaaacagagagtagacttgt   283150
agttgctataggctggaagttgtgcacatggcgaatttggtcaaagagcataaacagttttttccttcc   283220
tataatattattttcttaggttctaattttttgagctattgagattttcacatcataattttttggtctta   283290
cttatgcttgcatatcttttactactcttgaataattttagtcttctatatctttttggcttaaaatttg   283360
tctcaaattggttgcatttttcatctttggttttgttacaaacgtgtgattgtctggaatttttaattta   283430
tgagttcaaaacatttatgtttgttgaatattaattttactaaggcttagtttgccatcttgtttgacat   283500
gttcaatttagttacttcagaataagcataatataactgtatattttgtctttgaaaacatcagtttcca   283570
cctgtcatttaatagatatactctactggattaaaactatattctgttttttgttcttctacactgttgt   283640
tgatcataactgagcacagatactgctacttattttcccagtttttttttgttttgttttttcttttctt   283710
ttttttttttttaaggcggagtcttctctgtcccccaggctggagtgcggtggcgcgatctcagctc    283780
actgcaagctctatctcccgggttccacgctatactcctgcctcagcctcccgagtacctgggactacagg   283850
tgcctgccaccatgcccggctaattttttagcatttttagtagagacggagtttcaccatgttagccagga   283920
tggtctcgatcctcgacctcgtgatctgccggcctaggcctcccataactgctgggattgcaggcctgag   283990
ccactgcacctggccccttcccagttgttttataaatttagcaacatactattggttttataccaattgtg   284060
tcccatttctatatgaaaatcaaaatatatagaatacatcaagggatttgttgacagatctgataattt   284130
ctgtagcagtcctctaacaagacaaacatttttcaaacatgcatctccttttagtcccaccactgaatgc   284200
catttaagtagatagttcctagaatttaagttctgggctgttatctatgtaattgttgcattctttttt   284270
```

FIGURE 11A-56

```
tacccattttagccaaatataaattataaattattgattgtccctgcatttcatatattttccacaattc    284340
ttatcaaaatactcatattctttcataggtgttttctcaaaaatattttgagtcattgaaattttgttt      284410
agcaaaatgtttgagtccctttttgatcaattttttgttttactttgcctatactatttgtttctaaac      284480
aaaaaatttaaattcacagttatttttcttccaactttcaaatatcactactgtatctgcagatgttctg    284550
tgctatcactggaaagtttaatgtcagtctgattcttcattcatgactcagctattttttctccga        284620
aggctattataattttgtatttgtctttgacgtccttgaatttcatagcaatatatcaactcagggcact    284690
ctatgagctcattcaaataaagttttttgttctgtttgtctgttttaagcatattttcattcattcatca    284760
acttagttctttctgttttttttctctcttacctattattgatatatctaccaaaactgcctttctctcct  284830
ttattctttcctggtgtttcctatgaatgttcttccatctgatcttccaattcagtaattttgttcttcaa  284900
ttctctctgttctaagatttatcttaactattatgttcttgttcatctttactattacttattccatact    284970
tactatatttaccaagttatcttttaattcttattataatctactatttgaaatatattaccttaggtga    285040
tcaagtgtattattttgtcttttgtaatttcttcattgatctgttccaataattatatcttatgtagaag    285110
agttttcatctgttgagagagatagagtttggtaactttttaaatattcaggtatataactttttaaaa    285180
aaacatttagcctatatcctccttaggtgggtgaaaactcaaccatcagcctgtttgtaattgtggattt    285250
gatatgacttaaggccatgcccaagtctatgtttattttacaagattaacattcaaaaatcactttagg    285320
ttactctggtgcactgaaaacctgcaaggaaggcttcttatttgaaatgtgcctttaaactctaaatgaa  285390
ctggcattacaaagaggcagcctctttaacatcctttctgggggcatggaggggaaggggctgaagcagg  285460
aaaagcccattgtggccatgagtgactggtggcctgtaggttttagccgactcctcaatgcatctgag    285530
tttccctaggcttaccgaaatcctactacctgatggctgctgtagggttctatgttgtatggagaagag    285600
aagatggaagggagattagataatgattaactcaagacatttttgctaagagacaagagtgaacctaaga  285670
cttttctttcaaactggcatcgttgtgttaccacttccaccctctgccagaaggtttagccaccccatc    285740
cgccatatatcatggttcttcaggttgtactctctgcagaatggcttatagtttactgcttttatgttc    285810
tgttattgctctttcagtagatcgatgccttcatttttcttagcctctgtagtttctcaaatgtagatttt  285880
tgtggaggaagcagcattctgttctattcaccatctcaaaagaagcataaatcttttttcttgattatta  285950
gtattttcccaacccatcaaataaatctgtacttctaccacccccagactttgcactgaagaggattg    286020
agaaatggtgaaacacttagctattggatagctttttcattccacagacctcatcagttattgttagc    286090
taatatacccattaagaaaattaccgaggaaacaccacatacatcctattaattcatcacttgtcaaaa    286160
tccttctaagcacctttcatctatttctaaaaacattccaaatatttcagggacaatttcctaatatttt  286230
ggttttgaatgtcacatagttcatctatcatcatatatgatagctcatatacagaaaccaaaatattaa    286300
ctaattcttaatgacaattaggataatgaaggatctattagaattgctctgggtgtctttgattgtcata  286370
tgaattttaaccaaaggcttgtatgagttccagagagcaaacccactacattttcctgccctgacttc    286440
cagcccatcactatgtagatccattgtggagctttgttactcctttgtagtgtattaaattcgaggatat    286510
aatatcatctgattatggatgaaagtaatgggacacttactgccatgagagccctcgtgacaggtgata    286580
gttgaaccagaagtttaaagacctgtggcagacaggaggggtaaaacaataggacgcaggaccaggaa    286650
tacattagggaaggcaacaacagtgaaggaagagctagagtaattgaaaggctgataaacatatttggag  286720
ccagttcttttatgctatcattaagataaaatcagtaaatcagtaatccttgcctggtggatatttctt    286790
ctttgcaagaaaaatgttttaactaaaggaagtcattttttgataatttgatttatatacatacatatc    286860
ctctgtacaaattgcctccaagcactttggggacaggagaagaggggaaacctgtgagattgatagatgc  286930
tagatagatagataggtagatagatagtttaggttagagatataatttctctctataata            287000
tatttttctttgtctctctaaagacatgattaggaaacattctcttgctatatataagtatatatatta    287070
tatacatacttacatattatatataattttatatataaatgtaatatatattatttgtatcataaatataa  287140
atatattttttatatacacattctctctacaaatagaacatatctatcgagagagacatatgcagtatatg  287210
tatatgtgtatgtgtatgtatatctaaaacaaagaaacaatataaacacaaatccaaatgtcaagtgga    287280
agaaaactctaatcagctacaagggacaattagaacatctgtaagaataatatgtgtactggatttaaaa  287350
tgataaagacattaaaatgcatatattcatcatgatacccagaataaaactcactgttaatattactagg  287420
caatgatcacattctcctggatcttgatcaataaaaattatgattttcctacatttggaataaatactg  287490
aatttcacaataactaaaaaattgatgattacaagtaaaattccagataatatatgcaggaaaaacaata  287560
gtataagaaaatcattatttttgtgaaacccaaattaagctaagtgtgtgagtctgttctcacactgcca  287630
aaagaactgcccgagactggctaatttataaaagaaagaggtttaattgactcacagttctgcaaggctg  287700
ggaaggcttccagaaaactttcaatcaaggcagaaaggaagcaaacatgtccttcttcacatggtgccag  287770
gagagagaaatcaggtatacattataatttattcctcctgttttttttttgtttgttttttgtttgttta  287840
tattttccaaaataagaggccatccaacacagtgaagcaaaatgaacaaagacgttcaaatactgaa     287910
gttgagcataaatttgacttcacaatttctgtcagatgaaccaaaaaaaaaaaaaaaaaaaagagagag   287980
agagagaaacatttgattctgggattttttatttccagaaagaaagtttttctctttttctgtactgatta  288050
ttgattaagagtagttatgaagttggagataaaaggagaagatggcaatgattgttccttgttctttctt  288120
tctgcagtggctgtcagcttcactgatgatattaagaataacacagcaaagcctgactgcctccctaaag  288190
acagatacttccattacgtgtggcggtaccttcactcctgaatctagaaatactacttgggccatgtt    288260
aagtttattcttaaaagcctaacattgtgtagctacagctgcccaacaaatctgcccaaagcactgttcc  288330
cccaattgtgaatatgcatacaaataactttcagttttcatgcctactcctggatcatccaccaccagaca  288400
ttctgatttggaggtcgactgtggagccatgcaatttaaaattttacagactacccaaggttatgtgaa   288470
tatatcccgagatagcacagccttccaggctgttggtgccataaggacttggagagatcaccctcgctt   288540
acccacaaacaacttgcaggactaagaagagtgcttaatgaatatgtgttcaaaaataaaggaatgcac   288610
ctgtgcttggagataccctggagagctctctctctctctcttcatctccctctgtatctctcactctt    288680
tctctggctctcgttcactctttctctctctctgattcatttgctctatgccgctgagtcatacagtgag  288750
aagcagcttaaggtcattaaaaggttgaagcatcatgggaaaagtgaacatgttttcatttgaatctct    288820
atttttaactctttctgaacttgagactgttgcagtgataatgaaataagcctatggtggttcttggaaa  288890
tcattttagacacacaaatttctaacatatatagagataatatgtaagatcacattatatataaagtcac  288960
atagagtaagtataatatataatcatatataaaaaattacatataaaagtatattatatatcat       289030
acttatatattcatattatataaatatataatatatattaattatctataattttaaatatatttaaatt  289100
taaataaatttaaattaaaatataatttaaatataaattatatatgtaattatatattatacattatatt  289170
atatataaaatatatttcatattatggaaatatatttatatattacatattatatataatatataaaat   289240
tgtatattatataaaaatatatatcatatataaaatataatgtataattatatatacttcattatataat   289310
atgaaattattatatgtaataacacactatatatggtatataatatataacataatttaaatataaatttt  289380
```

FIGURE 11A-57

```
atataatatataattttatagaatacattatatactataagtatataattattttacatataatatatta      289450
tatataaaatataatataatatgtattgtatatatttatataatatttatatatagaacataatataaa      289520
tttgtatatgatgtatatcatatagtatatgtaattattatatctagtttatgctatattgtatgtaatt     289590
atatataaaatataattttaaatataaactctatatgatataatttatatattataatatatgattagat    289660
aatatataataagtatatatacttaatatatgtgatcttgttaagtataatacatatatatatataata      289730
tatattatatgtatataaaatatattaaacttaccatatatgatcttgtttgacatgtcttttgtatag     289800
aaaagcacttaaattaccccctacttcagcaatgaggatgttgtgtttaggccaaaaggcaatataaacac   289870
aacttgctattaaagttttttcttaatcatcactaccactgaaccattaataagtattttcctgcacaag    289940
ataataatagcatctcacatttccatggtactttataatgcctgaagctcttccacattcataattttgt    290010
tcatgtcatagaaagaatgagctttagtaacctcttccatttaaggggatcacagaatgagtaaaagcct    290080
agggtgcagttagaaaagaactaggtttcagtcatctagacatggttctaggactcttgaatgcatgtgt   290150
aactcaggctgaaaatcccggaagatacatccccatcccaagagcacctacacaatttcaataacctggt  290220
tacaactgatgcactttggatattgcactcttcacaaacatctatccaaatctaacatgaactcacatca   290290
gaacaactatcgaatccccactcctaccaaatattcacgtctggtattaccaccaaagcctgaagcaccc   290360
tgacaacatgtgtccagatgttgttgaattttttccatcctgactgcctctcaccgaaagccagaaccaa   290430
cttgctcctggatgactgcagtggacttcttccaaaggcagcctcctgcagtcacatccatcagtgcctc   290500
ttatggacttcacaaaaccataaattctatcacatactgctatcttcccattcttatgtcttgtcattgt   290570
ttttataataaattccaacattttagtcacttttccaagtgtgaagtcatttatgcctaccactgtaatac  290640
cattctttcacatttccttagtcatgatgagtcagttacactggaatccttctgttctcctcacccttt    290710
aaagttccttttggaacttgaaacttataattctttcaggaatgtttccctcttaacatcttgtggct     290780
gcttccctgtcatcatttccttccatttctacctttcagagaggctttgtttagaagaaaatataggag    290850
caaatctttgccagctaggcttatgaaaagttttcttacatagaacacaaaatacaagaactgtaagaga   290920
atgtattgattatgaggacttcaaggcaccacgaagaactcagacaaaaagcttcagattcagacaaaac   290990
atttgtaactaatagagcagagaattgacttgcatcttgaatatataaatatctcccaactcaattgt     291060
taggcaagcgccctatagagcagcactcctgaacatttttgacatcagggactggtttcacataagtcaa   291130
ttttcccatgtcggtggatggtttctgggtgaaaatgttccacctcaaatcactaggaattacattctca   291200
tcaataagcacacaacctacatccctcgcatgtgccgtctcaataggattccgctcctatgagaatata    291270
atgtcaccacttaactaacaggagatggagctcaggcagtcatttgggtgatgaggattggctgtaaata   291340
cagaggaagctttgctaggttgcctgcaactcccctcctgctgacccagttcctaaaaggccatggacca  291410
ggctttggtggtaatacaagatgtgaatgtgtggtaggagtggggattcaatggttgttctgacgtgtgt   291480
tcatgttagacttggatacatgtttgtgaagagtgcaatatccaacgtgtgttggttgtatctggtccag  291550
tactggaccatagcctggggattggggatccctgctgtagaggacagaataacaaacccctatgtatgt   291620
cacatcctacgtttgtgtggcaagaaggtcttaagtgatgtgataaagacttttaagatgggggacagcatc 291690
ctcaagtatctaggtgagctcaatgtaatagaaatatccttataaaacagaaactgaacttgaaacaa     291760
tagaaaatctgaaggtgaaacagaggtcaaatagagattaaggtgctgtgctactggctattaacgtgga   291830
agaggggtccatgtgttggaagcctctaaaagtgtgggagaaacaaggaaatagttccacaattgtacgct  291900
gcagaaggtaccagcactgaagaagcatttagacctctgatttccaaaactatcagatactaagtatgt    291970
gttgggttaagccaccaagtttgtgtatgtatgcaacaactaagaaaacatacatcacattatttaa      292040
cctttgcttgtaaacaatttgtctctccatgctggagggtgaatctcctgatatcaaagatcctgtttgt   292110
attgttcattgtctgtgtcttcaacactaaggacaaaacatgactagcatattttgagcattcatgtaga  292180
cctgttaaatgaacacatggaataatctcaaatgcctgctaagtattttatctcaatttcatcttgttat   292250
attaaaacctgtggtcagctgtggtggctcacgcctgtaatcccagctatctgggaggccaaggcgagag   292320
gatcaagaggttaggagattgagactatcctgactaacacggtgaaaccccgtctttactaaaaatacac   292390
acacaaaaaaattctagctgggcatggtggcaggcgcctgtagtgccagctactcaggagactgaggccgg 292460
agaatgacatgaacccgggaggtagaggtgcagtgagctgagctcatgccactgcactgcagcctgggca   292530
accatgcgagactctgcctcaaaacaaaaacaaaacaaaaaacaaacagaaatattaacaaaaacaaa     292600
caacaacaaataaaaacctgtgcttttttccaacaattaacttcaactcttaatcatcattcttttgcc    292670
ttgggggataatataaggttaattatatttttgtaaaacacaagagtcatgaacaaaatctaatggaccat  292740
acatagcctccatgtgctgtctactcatgatgcagtgtttcaaatataaaacatatatatagtatatatg   292810
tatacatacatatatacattcaacaagcaaacaatatatatattaccctggagaactgctttgttgaagc   292880
ctataaaagtttgtgtgtggagcttataaaattgagtgtgataaaagttggaaaattgagataaagtgga   292950
gaattgttactgtgatagttgcttaaaatctagttttttagaacaacactaagtttgaccatagctgtct   293020
ggtatgtgatccatttaatgttttttgcttttgtacattaattatcagagagatatcttagcctgagtat  293090
ttaaatctgttagtgaataaaagacttccatgcaacaccgagacagagttatcaaaaatgacaaatccttg 293160
acaattatagtaacaaactttagtacagtaagagatataataggacactgtaactgctctcagatcaaac  293230
atccctcctgcttagagaaaaaaaaaaaattgcacttagtgcaaatagaattgcaccaatttctctgatac  293300
agcctgaaaattaagccaacatttcaggtctgtgtaagaaagttgctgtcttctgcgttagaaaaggcat   293370
cccaggtagtggctgaccattaaaaggaagatgagcgttatgaggtagccatcttcaaaaagaaaaatgg  293440
caaagactttacaaaacccttaatgttacaatgtataaaaatagtataaataagtaagaacttaaagagac 293510
agagagtgcggttaaagcagcaagccagtaggacaatttttagtgtatagcttaaggtacaatatatgcat  293580
aatttgcccttccttaattctagaaaatattgtctgtcttcaataacctttctcttattaatgaaactaa   293650
acattccactgggattttagctctttttttatgctgtcatatttactttgctactgtatgtgattacaact  293720
aacttctaatttgtctaatatatgtgatattttatctagtatttcattcatttaatatgaattttaatta   293790
atctaatataatattgtaaaagtcttttttcttatatgtatttatagtgcctttatatgtgttttatct    293860
ccatactttgatggtgaaaacttactttcaattcaagtgttttaaaatactctcattaaaaacaaatgga  293930
aatataatgaaaaaaaacatttctgtaaactttcaaagtatatatggaaatgcactcaactgtggcaa     294000
catttttccccaggtttagcatattgcttggatgattatggctacttcatacatgtttgttgaatgagaa  294070
ttttcataaatttttatagtgtatgtaaaagctatggtatgttttttgtcttgtctttctcttttggctt  294140
taaacacatagtggctaaacacagagcaggctgaataaatacatccccctttatgcaaaattattcact    294210
aataaatggtatctagttcattcttaaaataccataagagaacacataatatctctttaccatttgcaa    294280
aattttgaagtcagagtctaatttgacagtcgatttttaccctttggactcgtttaattatttgaa       294350
gaacattatttgttcctcatgtgtgcaggtgaagcaaaactaaagagcatggcttctgatcttcatgga    294420
agcaggctagtaggcagctatttttttgtttgcttttgagatggagtttttttttcttgtcactcaggct    294490
```

```
ggaatgcaatggcatgatctccgcacactacaatttctcctcccaggtccaagtgattctcatgcatcag      294560
atccccgagtagctgggttacaggcatgcaccaccacacccagctaattttgccttttagtagagat        294630
tgggttcaccatgttggccaggcagaccttgacctcctgacctcaggtgaactgcctgccttggcaacc      294700
attttgaacatattccacatgaggcaccatgctgtttcttgtacattgtccagttgagttcctcagctt     294770
tctatgtgaggactactattctcctccctttttcacatgtaaagaaagctgggctttgaaatcttaaata    294840
acatgtttgaggccttacaatagattacacccccaaaggtgtcagactgaatccattgaatcaataactct   294910
gacagcaattacaaagcaaatgacctttgtgtaacatggtatattctataacagaaattcattgaatgcc    294980
atttagtgtgctgagacaatacagataatcacacaggacacttctggaaagaggtctacattggtagaaa    295050
gacttggccaggtcctacctgattatgtaggtgactcctgcagaagatgcagagcctgcccttcaggtca    295120
cactgacctttcaagtggtgctgtgtccatgagctagccatgcagctttttatatggcatagccacag      295190
gaagggatgctcaggcaaggtgttcaaggcaattaaaggctgcagaggccacccttagatcttgaggactt   295260
catataaaaagcaagcatttcaaaatccaaggcatattctggaagtagttagcaagtatagtggtggat    295330
ttgcaagctcaagaacataagtagggcatcccttgagaaggtcacatgggcccacacaggatgacccttg   295400
gattcccagtaatgaatttgtgtgtccagtacactcattatattgtgtgtgaatgtgattgctaaaaaag   295470
aagatataaattgtgaacaaaatataaacagttattagcaataaaacatgaacatttcctataaccacct   295540
cctttgagataatcactctccactgtttgaattccttccacatttttattttttaataaaataaatgggcc 295610
acgcaaagtggctcatgctggtaatcccagcacttcaggagacagaggcaggtggatcacttgaggtcgg   295680
aagtttgagaccagcctggacaacatggcaacgtctctgcaaaaaatacaaaaattagcccacacgtggt   295750
ggcacatgcctgtaatcccacctatttgggggactgaggcaggagaattgcttgaatccaggaggtggtg   295820
gttgtagtgacccaagattgtgccactgcacttcagcctggtcgaggctctgtggcaaaaaaacaaaaaa   295890
caaaaacaaaacaaaacaaaacccctaaaaaatataataaaatacaataaaaagtatttagcagcccact   295960
attttttttttttttcagatggagtctcactccgtcaccgaggctggagtgcagtcacatgatctttct   296030
cacggcaacctctgccacccaggttcaagcaattatcctgcctcagcctcccaagtagctgggattacag   296100
gcagcccactattttattgagacaccatagatgtttcctgtctcatgcatgtaaatactccttaaca     296170
cttcatgcaaacaaacagcatcccataatatggatgcaggcaagagaatccactcaagtcactgatttgt   296240
gaacactgagcttgctgctattgtttgtttttaaaattacaatccatgtgaattgcagagccttgggtgg   296310
ttatttttatgcatcagaataaagattttcatagaaaaaccattcaaagcattaggactcctaggtcaga   296380
agtctccaatttttaatttctgggttttactcatcctcttacattggacagcatcatgattatttgat    296450
agtgcagaaattcagagaaagctgaaaggacataaaacccaagtgggtaggtcctgaggactgtggttc   296520
tcatctcaggcactaggatgcagacccagggaggaacaagatgtacaagcttttgaaaaataaaaccaa   296590
aaggatgtgacagcaattgaatgagagtcatagcaaatctggagatatatttaaggagaaactgctcag   296660
ttaaaagattcaaagttgtctgggtgtgatggctcatgcctgtaatcccagcagatcacttgagctcag    296730
gagtttgagaccaacctggccaacatggcaaaaccagatctctactgaaaatataaaaattagtcaggca   296800
tggtggtgtgcgcctataatcccagctgctcgggaggctgaggcaagataatcacttgaattgggacat   296870
agaggttacagtgggccgaaatcatggcactgcactccatcctgggcaacagagtgagagagtctatcta   296940
aaaaaaaaaaagactcaaagttgactcaaagagaattgtttccaggcaggccattctcaaattttcattt   297010
ccatgaaactcatatatcaattatcttcaagttttgatatattattgtttattaagcaaactgtatttat  297080
tattttatattttgctcagaaaatatccatcttggtttttttatgtaattgaaactaaagcact         297150
taaaaaagcttatgcagcttcattatagatacatgtaggtggacattacctactttatgaaaatgatgca  297220
aggaatctgaataagagtttgtgggccccagagtttggaaatctgtggtataaataccatgtgtctgtta  297290
taattgtcttagatttctctatgactttggaaactaaattttggctctgtgaaataatgatatgataa    297360
catgatacaataggaaaatagtctgctagtactcattccattttaagtaaagtaaaaactaaaaatcaa   297430
aggcactgaatttcaaccagcctacctatcaagctcacgaattttgagtgcaggacgtcacgttccctcc  297500
catccagcacactctgtatatgtatgtgctcctgtgttgaatcctacacaatttaaaacagaaaactgaa  297570
gcctcacccttttaataaattgactatgaatgatttcctataaccatcaaagattagttttaatctattt  297640
gactgattttattttttatacctctgccttcattctcaccagatttctctttgaccacagttgtgtgac   297710
ctaaacaaattctgtttgttctcactgaataattttttatttaaactttttcctgtttggtgtcacttctt 297780
tagtttaaaggtgcatatgtgtgtctgtgtacatatacattcataccccatacattcatatatatggtt   297850
atatatgcatattgtatgtatgcgccagctacaggtaaatgacacacacgaaatggtcaaagatattta   297920
acttctctattcacataattatcttctggttacttgtctccaaaaaatgcctagtgtgtttatacgagga  297990
atgatctcataaaagaaagtggattatggctttaatgtcatataacaatgtcttttgttaattaaaagc   298060
caacaatatctgaccccatttggttccttaccattgacttggagggcatgcagaaacaaaagacctgcaa  298130
ttattctcctaagccttgtgatataattcaaaggagaggaaacatctacattattatttataataaaa    298200
gtggaaactttctattctaccaacaatattaagcccaactagaaatcctcatgtttatatgatactcat   298270
tttagtcaacatgcagaaggaaaaactgattcctgttttacggcacctttaccatgaaacatgttttaa   298340
ataaccacactaactgaatgtattagtctgttctcatgatgttaataaagatattcctgagactgggtaa  298410
tttataaagaaaacagatttaatgaattcacagtttcacatcgatggggaggcctaacaatcatggcaga  298480
aagtaaaagaggagcaaagtcatgtcttacgtggtggcaggcaagagagcatgtgcaggggaactgtcct  298550
tcataaaatcatcaaatcttgactatgaaaatagcatgggaaaaattcacgcccaagattaagttacctc  298620
ctggtgggtccctaccactatgggatctacaattcaagatgagatttgcctggggacacagcaaaatcat  298690
atcactgaaatattgattgatattttcttgtgtgtatattttttgttgtcgatgttccttccagagccctg 298760
gatgaaacttggcatcaatgtagccattaacatgcattaattctacatgatctctctttgcatctttcttt 298830
tgttgttcagttggtagaggagaggttgctgatttacaagcttcattttagggagagtaaaacttaaaag  298900
ccaaaatttcatcagctaacaggcttagagtatggagcctaaaggacctgtcgatgaaggaggttattcg  298970
ttgcatatctgtggttttagacaatcaagggggttgttttttcattcacctggaatgtgtatttaaagt   299040
taagtgatctacctgagagctgagtctctcaagaagagcactcatctttgatattatgcatggctctctc  299110
aagttgatgaggtaccatcattttgctctctacaatcaggaggcaaaacccagtgatttaggtgtgcagg  299180
attcctaaaatattaattttaacttgctacaaaaaatagcagggtttctggtgtctgaaaactttgaga   299250
aatcacaccattagaatattgttaagatcactctttattttgcacttaagaagataactttgtcaggaaaa 299320
tttctttcttcctatcttccttccttccttccctccttccttccttccttccttcctccctccttccct   299390
cctcccttccctcccacccttccctcccctgccatcacataatatagctataatgtgctgccttttc    299460
ctctcctccagtgttattgataggaaaactggccaggtactgatgaataaagaaaaagacaaatttata   299530
gtgagatctgattgtcacagatcaggtgccttatgaaaacaggtcattttcttcttcaaacaataacttt  299600
```

FIGURE 11A-59

```
ctgagctcagaatttcatgacaataagcccacatgcttcttaagtctcatttatataaaatgtgatttag    299670
acctcagaacactgtaactgcccaacagactcatctttactacacagatagagctgattagtcaagatag    299740
aagaattgcaataaacagtttaattcctacagagctggctaaataagtgattggagttttattattaccct   299810
aaatcagccttccccaaaattcgaaggcttgagtttttcaaggatagtttggcatttagggggctagggaa   299880
tgagtgctgctggattggttgggatgcaattatagtgttttggaaaacaaccctggtgcactaagtcacc    299950
ctctacatggggatacagagatgttaatggtcccagtgggaccaatcaattgtcgcaaataaaagcctga    300020
aaaggcatctcaaaaggccaatctgtactattcttatcacctgagtaacaacaattcaagatgagatttg    300090
ggtggggacacagccaaatcatatcaccgaaaatatctattgatatttcttgtgtgtatattttttgtggt   300160
tgttgttccttccagagccctggatgaaatttggcaacaatgtatccattaacatgcattaattctacat    300230
gatctcttttgcatctttcttttgttattcaattgaaagaggagaggttgctgatttacaagcttcattt    300300
cagggagagtaaaacttaaaagccaaaatttcatcagctaacatgcttagagtatgagcctaaaggacc    300370
tgtcagtgaaaggtcctgtcacatgaaatttacctacataataaacctatagttgtaccccaaacctaa    300440
aataaaaggtttttaaaggccaatttttagtttctagtgattggggaagttgcagatcttgtcacctatgg    300510
aattgtgtctggagtttgttccttctggtgggttcatggtctcactgacttcaggaaccaagtttccact    300580
cgacccaggaagtccacctggcttcacataccaatagaaggtgtctcctctaaactggacaccccaaatg    300650
ctattgggaattgggtgatgaccgctctacctacttcctgatagggtgcaaagaagtggccctgcag       300720
ttgtaatgtccttcagaggggaactctctagcccagtcttggagccacaaggtcgattcaggggtcctca   300790
gtagaagttgtgagttgagctcatttggggttccatttgtaagaccatctgtagcttgatggcctcgatc    300860
ctggaggaaacaaatttgacaaggagattaaaaatacagggcccaaatgcaagtaatagcaagatggctg    300930
tcacaggacctagaaaggggagaagccatgtcactcaacttcagatgttggtataagagtttgagaggca    301000
ttgtotgatttcacaagtcttttcctgtaaacactgagtggcatctcatattatccctgactggttaata    301070
taaaaacaacactcttcccctaagaaggtgcagagtcctccttctcagcagtgaggaggtctaggcctc    301140
agtagtttggagagtcactgctgccaaagagtctactgggattgcagtgtaaggaaagattttgttat      301210
ttcttgaaaactgtctgagaaatactttagagtgtgtgatagtagtaggataatggagtagataaact     301280
ggctattctgttttcctgtatcagtggccattcctaaaactataagtagggttattagttgcatggcctg    301350
cactgacgaacttgaactttaaggggcactgatagggtctgatttcctggggaaatgtcagtggac        301420
ttaggaagactaagttccaggtgcctgtccaggtggggaggcagacgtaggttcaagttccacataagaa    301490
gaacatgccttggctgagtagacagaactggttgtatatgttaaaaaggcttgtgataataataataact    301560
catatatttttcattttcccatactcctagagtacttgccaaggtacctccagagaatagctgaaaagga   301630
gtgttgggagaaaactgagtggctccctgtgttctattttcccattggagaaaaaaccgttgttgtatcta   301700
ctaggaaccattcaagacagtgatagaaagagggaatgagaaagctttcattagtggttggggatgctgct   301770
gcaagggtccagggatgaatggtcatgcagggagaatgtttgccattacaacaccccagactgttaagca    301840
ggtaggaggtgataattttggaggccctgagaagcagacaagccatctgaatggagctgtatgggtgac    301910
tcacaagttgctatgatctgttggtggttgaagttgtagagtattattacactgatggcattgtaggttt   301980
ccaggggcaggcctgataacagattgcactggatgcataaagaggcttgaaaagttaagatggtattcgt    302050
ggttacagggccatatatgggcttttcattgctagtgtaataggtgaaagtggaaatgtaagagtgtaaa    302120
agctggattccatgtcctgttagggtattcttggtaagctttgtgataacccaaatctaggaattatttc    302190
atgaattaggactttaaccacttcctgagcattctctgtcttgcagggaaggcttctatcaaatttcta    302260
aagatatcagcacagaccaacaagtattgaaatccccttaacttaggcataggcatgaactctaaatacc    302330
agtcctgcccaggatagtgccctattctttcttctcccagaggggcctatgatagaccatgggtttttt    302400
tctttggcacacatcacaggctttgactacttgtcagatgatctagaggagacatgtccttgtaaatagg    302470
gatttggctatttgatgagtgttctcaatacacatatggagagtttggtggaggcttttaagtattttcc    302540
actggctggcttcaggtatgagtacctttcccttttctgtcattaaccacccctagcatagaaaactata    302610
ccccgtgaaattttccattctgttcattgggaatactgggcttaatctcttggagagggttgttc       302680
cataccaagggtccttccacaggtacttctaatgggaggttccgcctggtagcaattttggcctcagagt    302750
ctgcctgacagtttctaccttttctccttcatctttttaatggcttggcagcacaagactgccaactcc    302820
ttggttttttgcactgtgtgcaataactccatgatttccttgtggcatttaatgggggttccccccagaagt   302890
taggaactcccttttttcttcatattgtagcattggcttgtagggttagataagcatagttctacctata    302960
tacacatttattattttttgcttttcccatttctaaggctcgggtaagcaccagtagttctgctaactggg    303030
tgctgatccctgggtgaagagggttacttttcaaatactgttacatcactatggcataacctgccccttc    303100
atctcccattctccacaaacgaacttccatcgtctctataggttaaggtcaggattagctaagggactc    303170
ttagagatcctcttgggtgacacagtctgggctacaattgttggcagtcatgctagatcggctcccatgc    303240
tatgggagaaaagtcgcagggttgagggctgcacatgtgcatacttgaagcaaagtctcaaggagtagca    303310
cctggtatctaagcaggtggttatctgatagccataaacttcctttggcacctagtgtgccatttacatc    303380
atgagtagtccagacagtgagatccttttccttgtattatttttgataatgcctctgacactaagatggccacc   303450
actgcaactacccgttaacagtgaggccagccttttgctactacataaatttccttacttaggtatgetg    303520
ctggttgtggggacacttagtgcgtctgaataaggactccaagagctatttccactcttttctgtgatgta    303590
taaaaataatttttttcatgtacgaaggcttaaggctacagcttgtactagggcctgctttaaggttttg    303660
aaaactgtttctgcctctgtttccattccactagatgagtatttgccctctgggtgtccttgattaaag    303730
tatagagtggcctggccatctcgccgtatccaggggatctggcaaaactggtgatcccaaggaac        303800
gtctgcaactgtttaaatttcttagggcaaaggataagccagtatgggctgcatttattctttgctgagg    303870
gttcctctggttaaaattaggcctggatatttgaattgttgtaggcagagctggccttcaattagatgcc    303940
ttttaccattgattagctagaaacttcaagagatctatagtagactgctggcatgtggcttccaaactgg    304010
tagcgaaaagtaaatcatccacattctcaaggaccagtgtacctggacttgagaagtgacctagatctgg    304080
gatagcacctgaccaagacatgaggggctatccctaaatgcttgaggtaagaccgtccatgtaagttggg    304150
atgtgtggtctgtgggatcctcaaaggtaaagagaaactaggagttagagtgcaggggaatggagaagaa    304220
ggcatccttgaggtccagaacagtgaacaattcttttcctctgttgagagtgtagaggtataggtcttg    304290
ggtgcacctggatatagatgaatttctgcctcattgatgaatctaagatcttgcactagtctccactaac    304360
aattcggttttgtactcctagaattggagtgttgtagagactgctgcatttcttgctaagccttgaga    304430
ttttagatgtctaacaatatcctataattgtttatgagcttcagaccttaaggggtatattgctttgataa    304500
ggaaaattggtggggtctttcagcctgatttggacaggggccaacatttttgcccttccgaactgtcctt    304570
acaatgcccagactccaggggttgattcccctcaagcagtggacaacagataagtgacttgttcccat    304640
attcatatggataatagctccagctttggctaatatgtcccttcctaataagggtgtgggacttttgagg    304710
```

```
ataacaagaaaggcatgtgaaaagagcaaagtctcccaattacaactgaggagctgggagaaatgcctgg      304780
ttacaggctgccccaggattcctcagatggtaatggaccttcagagcagccatctgtggcaggatattaa      304850
cactgagaaggccacatccatgtccagaaggaagtcaatgtcctggtcctcaatggttaaatgtacctgg      304920
ggctcagtgaggggggacaaaatgagctggtgcttccacaggcaccctcagtcctgctgttggatcacct      304990
ggttggggactgctggtcctgagaacctttgtcctctggggcagtgtgctttccagtgatgaccttggca      305060
tagtggacatggccaagggggtgacttgtttctcactggacaatcttttctaaggtgtccttgaaaacca      305130
cactaataacaaccccctaccaggtaattggtctgatccattttctgtcctctctgaagcaccaaggtttg      305200
tttgactgagggccatgactgtggcctttcactgatctccctttttcctttgggcctgttcctcttggtc      305270
tctattatagaacaccaaatttgccaggtttaataatgcctccagattttgttcggggccagggctcact      305340
tttggagctttatcctgatatctgcagctgattggatatgtgttaggatcaattgaccctcgagggagtt      305410
ggttgacagggaatatatttttcttaaggcctcttgtagctgctcaaggaaggcagtaggattattttcc      305480
tttccctgagttatggtggacatcattgattaattcatgggcttttcctattctcctagtccttctag       305550
aacacaggtcaacagatgtttgtgactccagtccccacgatctgagtctagatcccagtggggatccata      305620
tgggttacagcttgctgaccagtagggaatttgtcccttcttcggctgttattctatcatttacttaac      305690
taaaataccagatctccaaacactcaggctgtagctaaagccacttttattttcactaaaggccaggtttt     305760
gatctaacaatagcatgatatctttccaagtgaagtcaaatatttgccctggaccctgtaggacatctat      305830
atacctattcaggactatctgaaaacatcccccaggtctaccttatctgctttaaattggagagggagaag     305900
gggacatgtacctaggttcagtcaaattcccctcccctgacagcttgaaggggacataagccatagcctg      305970
ggggtgtttgtggtcccttggatatttctttgcttgttccccttctgggtgggggagactagagggaggct     306040
tattactgataggaaaagggagctgtatagatggtaggatatgaagctaaactgagaggtcctcctgtgga     306110
atgtaaatttcaagctttgccttgttgtggattatccttcaatgaaaagaaagcttagacataagatatt      306180
tcactcaatttgccttctctcttacaggtcaaaggacagtatggcattctaatttatacttccctcaggt      306250
ggtcattttttcccatcagagagagaatattgaggccaggccatagtgcagaaaaaaaaataagccacttc     306320
tatttcagtgtttgcagatcaaattgttcccaatggcttaggatgcattcaagggtgagcttgttgatg      306390
cctgagtgattcccatctaaaagaaaaaaacaaatgtggttttggcttttttccttgcccaagat          306460
cctgcaacagtccctggaccctgatgttccgaatagttgtgctcgccaaagcagcagcagaaacactagt      306530
tttcctcctagatcataaggaggaccaataaatgtcggatttagtagcccttaccaacacattcttgaaa     306600
atcaacacccttgcctttcctcttagaccacaaagaggactgagaaaaatcagatttagtggcccttagt      306670
gatgcatccttaaaaatctgtaagagtcctaagcattcctcttagtattgggaccttatccttgtcct       306740
ataaagatgatatgcatcaaatggagtggaggcccataccctagggagggaagggatctccaggggttg      306810
gaagagtgacaccttttgtcctcacttctcatcaatgaaaggaaggatataatttctgaggctcccctt      306880
atcctagcttcaggaatagcctttgttaggcctgctagtctgaggagggttgataaattccagatcatcc     306950
ccctcccaacaaagcttcaggtgaaaactatgttttttctgatagggagcctgggtacctaaagaaggaa     307020
cagagtcccacagtttataccataaatcatttataggagaaactagaagatcaccaggacagggagttg      307090
tttttagacacagggctaccttcagaagagaggcagtaggaaaggttgtcttacaggcgttaggaccc      307160
agaaggcaagggtcacgatagataggatagatgggcgagtctcgcttgtgcaacataactttgaaagtta    307230
tgctcatggctgcagggtcaaccaacttttgttgggacccctgagctgaatgactttcctctctgtcaa      307300
cccttggctcagccaagaaatgcaggaaaaatggaagctggttccaggcaaatcaatgctcccaactcca     307370
aagattcagtggttgttagagagccctttcccagaaagcctgacacctgagtcttttagtccagcagccac     307440
gctagttgcttttaactggtcaacaggtgcctggtatttagtccccgaattctaaagaaaaataggacag     307510
aatagcaagtgaaaagggtccagcggtactcaccacatggcaatatcctggatgagccactagatgtgtc      307580
cagagttggttcctgccagtgggttcgtggtcttgctgacttcatgaatgaagctgctgaccttcactgt     307650
gagtgttacagatcttaaaggtggcatggactcaaagagtgagcagcagcaagatttactgtgaagagtg     307720
aaagaacaaagcttccacagaatggaagaggacccctagtggggttgccactgctggctggcagttggccaact 307790
tttatttttcttatttgtcccatcccatgttgtctgtctgtcctatcagaatgcccttttttacaatcctcc     307860
ttgtgattaactactttaggttattatagagtgcagatttgtgcattttacagagtgctgattggtgca     307930
ttttacaatcctcttgctagctacagagtgctgattggtgtttttacagagcactgattgttgcatttta     308000
caatcccttactaactacagagcgctgattggtgcattttacaatcctcgctaaagagtgcttattggt      308070
gtgcttttacaattctctcttgtaagactgaaaagttctccaagtcccccaatccgaccccaggatgtccacctag  308140
gttcacccttttcagataatgtttggtaattattttaactaagccaacatcttagcagaattcaggcatctgt    308210
catttttctaacctgctggtctttcattagttttacaaaggttgtttagttttaagaagggctattatca      308280
tttaaactataagttcaatttctcccaaagttagcttggcctatgctcagcaatgatcattgtagtatgg      308350
tggtgaaagacaagatggtgttggttaggtcagatctctttcactgtcataattttctcacagttacaag      308420
ttttgcaaaggtggtttcaagatgaaaggagttaaaggaagagcgtaaaattatttcagtcattc          308490
tgtacctgaaacaggcactccccctttttgatagtttaaatttaaaaagaaaattaataatccctggatg      308560
ttgcagtaaatgaaaattccaatgcagaaactgtgaaaacacatgcttcaaaacaccacattctttgtt      308630
aaacttcagagatgcaagcattgccatttcccttggcaagcttacagaatatttggaggaaattctgaac      308700
ctcaaagatcaatccatccagtggatgctgtttgaataactaagattttgaacacaagggacattcat       308770
tagcctgctattggaaaggttacaaaaaaccttgttttgtaagggaggaagggattgtggttggaagaag    308840
gccagtgattcacagcatgttgaaaatcttcacgatcctctgcagaaacaaaataagccaacagatcatt      308910
ctgcagaattgtgaaagagagaacagtgagttaagaaaagatgtgctgaagacagaatcattctgttaga     308980
aaattactcgtgcctaaaaattaattacctctctcttaataggggacgaaagcattgccctgtggtat      309050
tagagggcacccacactgacattattcatcattgtcatatgtaccctgaatgaaaggattcttcttccca    309120
ggcaaagcctgatgctctttatgaacaaaccgtgtcaaagattgtgatggagactggtgttgcagaac      309190
atttttggcataaagcactaattagtaatcactaattaaatggtggggggcttgcgtaatgtctgaacat    309260
acccactaatcacagctaatctcacatcaagtttctctgaactttaaagaaatcacattggtaggatgtg     309330
tcttaagtaagaccaacctcacagttgcaatactgcctctccttgaagctgcaggcaatggtgactcctg    309400
atttaggcttggaattattgtcattgtaggaaaaaaaaatctatgactttctttgaagcctggccat         309470
ttcctcctttccagctcagagcatttttccaattgttcacgaaacctaatggaagaaaatctggttaact     309540
ctactggtatgcagcctcatcctctactcttttgttttaaagtagaagccaacactcagtctctcatt       309610
ggaatgctgtcaactttggttaggaatatgctttgaagtagttggtttggatttatgttattttaggct      309680
taaagcagtctgtcatcatacaaacaagcccctcccttatgtgacactgttgttcataaaggcatcaga    309750
ctttgctcgggagaaatgctcaactaaggacaggaaaatggtaaaaaacaacaacgcaagaaaccttccc   309820
```

FIGURE 11A-61

```
caaatactcaactataatatttgttccttacatacaatttctttttttgaagatctacgtcattaactca    309890
tttgaagggacatttagtacgtaatttatcataggagtctgttgtgtttaaagaaaaatgtgcacacaaa    309960
tggtaccttgaacctcgtaaaatttacaatgacttctgggattgcttcatgttattaatattttagattc    310030
attttgtcttctattagccacatatatacccaaagatgacaaggtatcataatgtcaacttaacaataat    310100
cattgtttatgtaattatttctgccacaaaaattttttctctagttttttcttttaatttcctgtaatttcc   310170
actaacactgtagatgcattttccttctacattagccacatatatacccaaagatgacatggtatcata     310240
aggtgaatgtaaacaataatcattatttgtataattatttctgccacaaaaattgttctccaggtttttc    310310
tctaatttcctataatttccactaacattttagatttattttgccttctacattagccatatataccaa    310380
agatgacatggtatcataatgtcaacctaaacaataactattatctatgtaattatttctgccacaaaaa    310450
attttctacagtttttcctctaatttgtggggacagggttgtggagagagagaatgaagaaggcaagct    310520
atgagataacttttcaaatggtggggatgtgtacacaattttttgaccaacaaaaatgtcctgtgttct     310590
tctgtagGTTTTTAAGTACCGGTGACCAGGCAGCAAAGGCAACTATGGGCTCCTGGATCAGATTCAAG      310660
CACTGAGGTGGATTGAGGAGAATGTCGGAGCCTTTGGCGGGGACCCCAAGAGAGTGACTATCTTTGGCTC   310730
GGGGGCTGGGGCCTCCTGTGTCAGCCTGTTGACCCTGTCCCACTACTCAGAAGgtaataatggtgtcccc   310800
ggggtgggtgggcaaatgccctgaaccaagaaatgaatagtcagagttcatagctgagattcatgtccag   310870
gttgccagaagtcactgtggaaattgcaacagaaaatgcccaaaagacaaaatgaacccatcttcatata   310940
ttttaactcagcttttttttccatttgctctgtcactcaggctggagtgcagaggcatgatcatagctcat   311010
tgcagcctccaactcctgagcttaagccttctccaatctcaacctgctgaatacctgggactaatggtta   311080
aattttaattttttatttttatagagaagtggtcttgctatgtttgctcagggtggtctcaaactcctagc   311150
ctcaagtgatcctcctcccttggcctctcaaactgctgaggtgacagaattgagccaccatgcttggtta   311220
gcaatatctcctcatttaagtgtgtgacaattaggtgtcggttacaatgataggaaaaaataactgctt    311290
tagaagggcggacactattgtttctttttgacagtctcactgtatttgaacatttgaattttattaactt   311360
ctagctacaatttggtaagagtaatatggaagagagacagtacgtcaataaggaagagaaatagtatgtc   311430
aatattgcagattttatagattttttaatcaactgggctttttaaccacgtgttttttttaaaagacacttctc 311500
taattcacattaattctttaaatcttctggaaacattaggaacatggctggtgcattcatagagaagtag   311570
attctacccataggaatagtgtctctctccctgactctgtctccctccctctctctcttcccctttcact   311640
ctcctctttccctctctcttcctgtctctccctctctatgtcctctcactttctctctgtctctctctct    311710
gttttcctctgtctctcgcccttcctctctcccctccttccactgtctctcctcgatctccctctccctc    311780
acactatcctctcacctcttttctcctttttctccctctctctctcctctctctccctc               311850
cagttcccagttcttcctcactgtctctcttcctctcttcctcacttccccccccttcacactctgtctctct  311920
cccttatttctttctctctgtctccctttttctccctctgtctctctttccctttcttcctctcctgcaaa   311999
catgactttcagcaaaggaccacccttactggtcagttcagcatgaggcacttggaagtgtccacagtttc   312060
ctttatctctctctctctaacacacttttaggaagaacctccctgctgggccagtcagcatgacatcctc   312130
tacttgtccccgtgggagctccaaacctccctgggggcctgctaataacctggaaaaagctgctgttgg    312200
caaaatagggaagggaaaccgcagaaacacactcacatcatgttacctcaatcagacatgcacttgta    312270
tgtggtagttagcataggcaaccacacccaaccagatgtgcacttgggcctctaagtagtaattgctcat  312340
gctgcctaagtggtggtcagcatagacagccacaccctgagccctgccagagcacctgaggctcactca    312410
atgcaattccctgatgctaatgcaagagggaggctctctgcagtatcagatgaaacttcaaagagaagtc   312480
cacaggaatttgtggcaattggttctgtgaagctggatcaccaattcttggctgtggcctaaaaggagaaa  312550
gcaggaaaatctgcagaacagatccagcctctgttacctggccaggtacaaatgaatattcataatagc   312620
catctcagtcatcaacacagcattgtgatatgttctgtgtcattggtaggcttcagaatggcaccacact   312690
gactggaccatttacatctgaagtactcaaaatcttaatggaattttctttcttttcttttttttttt    312760
tttttttgagacggagtctcactctgtcactcaggcaggagtgcagcatcatgatcttcactcatgtcaa   312830
cctctgtctcccagttttaaaatgattgtcctgcgtcagcttcccaagtagctgggcttacaggtgacca   312900
tcaccatgccagctaattttctattttagagatggttttttaccatattggccaagctggtctc         312970
aaacttcttgacctgatgtgatccgcctgcctcagcctctggaattgttattattaaagttatcagctg    313040
ggtaaggtggctcatgcctgttatcccagcagtttgggaagctgagtggggagtatggcttgagcccagg  313110
agtttgagcccagcctgtgcaacttagtgagaccacatttatacaaaaataaataaataaaaacaagcca  313180
gggctggtggtggacgcctgtggtctcagttgcttgggaggctgaggagggaggatcacttgagccaggg  313250
aggtcaagtcttcagtgagctctgaaggtgcactgcacctcaccctgggtggcagagagagaccctgtc   313320
taaacataaagaaataaaattaaaaaaaatacctttcttttaaagtaactgcaggacttttcttcacttcctg  313390
caccatctgaacaagtttctagatcactatgctcctcagtgtcttctttagcaagataggacagatgagg   313460
atttcctaaaatcctccaaactctgaattccttgagttcgtagttcataatgttttgcccaggagaccaa   313530
atgacttttgacctcaaactagtgctaataacagggaagaggaaaggctcatatttgtagtaactttatt  313600
ttaaaaacaggaacaatgaataatctgatgaaccattggcatagagatttctatgcgcattttgaaaat   313670
acatagatattcacatttctcagttgatatgacagttgtagatttagaaagcagtcagaaccaacttcdg  313740
gagtaatgaaacacatgtaagccacactaattagaggaaagtgttaattattttaagtcagcaggttggaa  313810
gttattatttgctgcaaaaataccttttgttggtcatttatgcaaggcagtgcttctaaacagcccatc   313880
agtattatcaagaattttgaaaaatatgagcccggcactgtggctcctgcctatcctcccagtactttgg  313950
gaggctgaggtgtgaggattgcttgagtccaggaattcaagaacaacctgggcaacaaagcaaaaccttta 314020
tctctgcaaaacattacaaaaattagccaggtgtggtggtgcacacctgtagtcccagctacttgggatg  314090
ttgaagtgggaggatcagttgggcctggatggcagaggctgcagcaagccaagatcatgccactgcactc  314160
cagcctgggtagcagagagacactctgtctgaaataaagataaagataaaaatacccaaattgttggcct  314230
taggaattctagtctaatgaaggcaaagtacctgtggaaagagacagttttatgaagatattcacccag   314300
tattattcatagcaaagaatgaaaatgaaagctacaagatcaaaaggagatgaaagttattagaaac      314370
catatgcaataactcaaaagaataatattttacctaagatattcaacagctggaaaaatgcagtgtagac  314440
aactatataaatattgggctcagctattcaaaacaatgtttgaatggaagagaaagatgtaagaaagaat  314510
tatgttaattcccaacatactcattttgctaaggtgagttttgctttaatgtttgacttatgggtgattt  314580
tttttcattatccaagttttttagtgtcatcaggagttatattactttcctaacatacaaataactgttt   314650
tatatatgttacttatatatatatgtgtgtgtgtatatatatatgtgtgtgtgtatatatatgtgtgtgt   314720
atatatatgtgtgtatatgtgagtatatatatacacaaaaatatgctgctaactagat               314790
tattgccagtagttataagaagggtaggaaaggaacatctcagagcattttttatctaattctgaatgttt  314860
taactaatgaaagtatccaacagattacatattgacatttttttcttttggacatttttaaaataatcttc  314930
```

FIGURE 11A-62

```
agagccaagtactcaagtcaatacttgtacatttctgacagaaatgtttccaagatggctttgctgacat      315000
aatggttaaagccatattggtttcaagttgcagtcctgtgtgtcatctttgggcaatcctttagtctttta    315070
aaaatcatatcttcctgatgacaatcacatttcctcatatttgattgcttccatgacatgaaaaatcaa      315140
cacggcatctggacttacagctgaatgctttattctttagtgcctgactcagtctgggatttacagaaac    315210
gtcaggaagtgatcgtaaatggaatgctgtgattttacggcctgccgtctcttgtcctgttatgattaa     315280
aaatacagatttatacttctggacattcatgtagtagactgagctgatggagaattttaagctatacag     315350
aattttactcctaaaattgcccatgctttttcaagtttctcaccaagtggagaattttcctatgtggca     315420
aaaaaataaaaaaaaaacaaaaacaaaaacaaaacaaaacaaaaaatctctgagttaccagtggatat      315490
agttttgaagaaaatgacaaaaaatacttgttagttgggtacctggttgaggattaggcatagctaagct    315560
aatgcatttacattaattcccaaaccgtaatatcttcattagacgcagggtagaaatgcatttctaaatt    315630
agcactctgaaattcattcaactggatttattttttcccataatgaagagacacctggatttgtttgtga   315700
gacaagatagcctttgatcttttactagtttaaggcctgttttttttgtttgtttattttccccttttggaa 315770
atgggaatgtagttgctgttgcatttttatgtatggcatctgaaggtaaggaagcaaaaatgacactaaa   315840
ttgtggaagaaaaaagaaatcacatgtattttaccagtgcacgaaaagcctcaatgtggtttcatttcc    315910
ttaaactcgtgtgtgtgtgtgtgtgtgtagaataacattccctaaaatgaatgttcagggggagggaa    315980
tcaaaatgaaatgggtaaaagagccctctgacagagctgaatgctactacatccagaaattcacatgct   316050
tgcgaaacaatcacagccttcattgctcagtaaaagctgtttctgtcctgcaggttttcatttgcatgtc   316120
cgcaattttgcacctgcagGTCTCTTCCAGAAGGCCATCATTCAGAGCGGCACTGCCCTGTCCAGCTGGG    316190
CAGTGAACTACCAGCCGGCCAAGTACACTCGGATATTGGCAGACAAGGTCGGCTGCAACATGCTGGACAC    316260
CACGGACATGGTAGAATGTCTGAAGAACAAGAACTACAAGGAGCTCATCCAGCAGACCATCACCCCGGCC    316330
ACCTACCACATAGCCTTTGGGCCGGTGATCGACGGCGACGTCATCCCAGACGACCCCCAGATCCTGATGG    316400
AGCAAGGCGAGTTCCTCAACTACGACATCATGCTGGGCGTCAACCAAGGGGAAGGCCTGAAGTTCGTGGA    316470
CGGCATCGTGGATAACGAGGACGGTGTGACGCCCAACGTCGACTTCTCCGTGTCCAACTTCGTGGAC      316540
AACCTTTACGGCTACCCTGAAGGGAAAGACACTTTGCGGGAGACTATCAAGTTCATGTACACAGACTGGG    316610
CCGATAAGGAAAACCCGGAGACGCCGGCGGAAAACCCTGGTGGCTCTCTTTACTGACCATCAGTGGGTGGC   316680
CCCCGCCGTGGCCACCGCCGACCTGCACGCGCAGTACGGCTCCCCCACCTACTTCTATGCCTTCTATCAT    316750
CACTGCCAAAGCGAAATGAAGCCCAGCTGGGCAGATTCGGCCCATGGCGATGAAGTCCCCTATGTCTTCG    316820
GCATCCCCATGATCGGTCCCACAGAGCTCTTCAGTTGTAATTTCTCAAGAACGACGTCATGCTCAGTGC    316890
CGTGGTGATGACCTACTGGACGAACTTCGCCAAAACTGGgtacgttcttcttcatgttggggtatcactg    316960
tcctcttcgcttgtttggttcctcagtataagtgttgcttctaccggcatgtgcaggagcacacatgcat  317030
gcacacatatacacatacagacacaagcttacacacacagcaataacaggcagcttctcccccatcatct  317100
gtgagaactcaaattttctttattaccaaagtgttttactcctaaaacacttttagtgtcaaaccagattt 317170
ttactagatttctaattgcccattagaaattctagaattcctacttgcaggtgcaggacttacacatata   317240
taatggttttgttaacagctgatcactttgtttttgttcttactgttgttgaagagacacagtctcact   317310
ctgctgtccaggctggtgtgcagtgatacaacatagcacactacagccttgaactcctaggctcaagca   317380
ttctcctgcctcagcctcctgagtagcttggattacaggtgactgccatggctggctaatgttattttt   317450
tttattttttgtagagacaagttctcactctgttgtctaggctggagtgcaatggtgcaagcatagctc   317520
acggtggcctagaaatcatggatttatttgatcctcacatctcaagcagctgggactacaga          317590
catgcaccaccatgcccttgcatggattttgtagagacaggggtttcctatgttgcccaagtcgttctga  317660
aactcctggtctcaacggatcctccctcctcacccttctgaatagctgggactacaggtgaatgccacca  317730
tacccagctaatttttaaaatttattttgttagaaacaggattttgctatgtcacctgagctaccacttgg  317800
ggaattgtttagattgcctgaccatatgaatacaaacaattgtcacaatatttatagagaaatataaata  317870
aatattcctatatatttaacatatagagagaaaagaacatattcccatatgtataatatatatatatta   317940
tatatatatttgcatttgtatatatatatacacataaataccagtatatttctgtgtatatacatatacaaa  318010
tagtaatatatatatactatatatgcatatacaatatataatatagaaatacaaacaactacaaatatat  318080
acatactatatacaagtacaaatttatgtacatatacatatatatttgtatttcctttgctgtataaa   318150
tagatagagagcaaagaaaaatatatgatatttatatattatattgttatatgtcatgcatatataaacaca 318220
tacacacacatatgtcacaggaaagctcatttattgacctaaatatagtagaaaatataacaaaaaacaca  318290
catacaacagagactgccaatattctactgagtggattctcttcaaaccatgggagaaaagaaacaaaag   318360
catcctaaataggtccaaatattgtggcatcttttaattttctcctgtctaataatgtaactatgaaat   318430
caatggagtatcattctgttctacctgtgtgtgccaccatcatccaccctgagtttctttaaactgaata  318500
gaagagcaacatgtgcatgtcacccaggagggtcaatcttcacatcgtggaatgaggctctcagactgca  318570
gtggccctgccacgcatgagctgtacacagtaattctgataagtcagaggacacgattttttgtttgttt  318640
gtttggttggttggttttttggcaaacatatagcatgttagcatgttttgaagtggaaatgtatcat     318710
ctggatatcaactttccaaaatcagactgtgtagatttggtctgagaatggctaccaggagagaacaga   318780
ggagggaccaacagttgttggagatgctcgtctatcactgaaaggttctttcctgcatgaaagaatgatt  318850
taaatcaaattcatatttttttctaagtaaaccttgtttattagttgggctgctgtttaccagag       318920
tgccaaaatctgtatggctgtgccgggcagagtggcttatgcctgtaaccccagcactttgggaggccaa  318990
ggccggaggactgcctaaggaggtcaagagtttaagacaaccctgggcaacatagtgagagtctgtctct  319060
acaaaacaaatgatgccccacaagccgcaaaaccagcaagtttttattagggattttcaaaaggggagg   319130
gagtgtgcaaataggtgtgggtcacagacatccaagtacttttacaaggtaatggaatatcacaaggcaaat 319200
ggaggcagggtgagatccacaggaccacggcagcggggcgaaattaaaattgctaatgaagtttcgagcac  319270
cattgtcattgacaacatcctatcaggagacagggttttgagagcaactggtctgaccaaatatttatta  319340
ggcaggaatttcctcttcctaataagcctgggagcgctatgggagactggggtctatttcaccctacgg   319410
cctcaaccataagagatgggctcacctagggggctgtttataggcctatacttccaggcgagtattctc   319480
tttcccaggagtgttccttgctgtgagaaaaagaattcagcaatatttttcccatttgcttttgaagaaga 319550
gaaatatggctctgttccgtctggctcactggcagtcagagtttaaggttatctctcttattccctgaac  319620
aattgctgttatcctgttctttttttcaaggtgcccagatttcatattgttttaaacgcacatgttctacaa 319690
tttgtgcagttaatgcaattattacatggtcttgaggcaacatacatcctcatcagctgacaggattaag  319760
aaattaaagtaaagacaacataggaaatcacaagcgtattgattgggaagtgataagtgcccatgaaat   319830
ctttacaatttatgtttagagatttgcagtaaaggcagcataagaaattataaaaatattaatttgggga  319900
acaaataaatgtccatgaaatcttcagaatccatgttcttctgccatggcttcagccagtcctccgttt    319970
ggtgtccctgacttcccacaacactcagtattagggtgggagtgatccaatgtcccaggtgccatctgtt  320040
```

FIGURE 11A-63

```
accccttctctttgactaggaaagggaattccctgacccccttgcacttcccaggtgaggcgatgcctcgcc      320110
ctgcttcagctcacacttggtgcgctgcacccactgtcctgtgaccactgtccgacactccccagtgaga      320180
tgaacccggtacctcagttggaaatgcagaaatcaccgtcttctacatcgctcatgctgggagctgtag      320250
actggagctgttcctatgcagccatcttggctccacctaccagtcttcatatattttatagaaccattaa      320320
aacaatagtgaaatctaaataatgctgttaaattctcattaactcctcctgactcccaaaggctatgata      320390
ctgaggctggctatgtcactattaaaaaaaaaaaaaagaaaaaaaaagatacgaaaagataaaggaagt      320460
taaatcattttatgaggtgactattatcatgactggcatcaaatggatgcttttaccaagatatcatgaa      320530
agtctgaaagagccgtgagaataccagtgatctctctgttactgagtgcttttaatgccatgaatctat      320600
ttcttaaagtcacctggtttagagcctgtgatttccaccctgcatttagggagtacattcacattgccat      320670
ttatggtctgtgttgagggtgcttctagcttttgtgaaggccctgacatcaccggaagagaggaggaagg      320740
aaaaaccactagaaccaccagagcagagattctctgatgctactcaaattaaaaacttcagatagagagt      320810
tcactgaggtaatgagagcctgaatgtcagtctgtctgaagtctctattttttgtttcttccatccatagg      320880
aaacatccctgaaataacagagtgtattaatgcagtgagttcttttgtttcattagaaatgtattagaat      320950
gactcaaatgattcatcaaggaagttactcagaacttacatgtcatgtgaaatgcatgatgtggattcaa      321020
atataaatgttttaagtgatcacacttgtttggcagccctataagagaaagaaatgaggaatttcactgt      321090
tgctagttatttgcttattgtaaactggatggtggcctgatccctccagggcagagaaagattccctggt      321160
cgtcaggtgcagagaacaaatgaaactgatacctgtaaggagaaaacatggatgtatctcatctgctgt      321230
catggtgtgacctggcaagtttaacaccattctacagagcacacactcagacaatgactcacagaaaagg      321300
agagggtatttctgcatatcctcactgttcccttccagcactggaggtgacaagaggaaacaagaatagc      321370
tcccagcgtgtctgtcagtacacagtgctgtggagagaggatcacattgtgccaagacatacttcccccac      321440
tctcagtggtcatcatgtcatgtgttttaaacctgcaggcatagcacagtctcctgatgacaaatgtttg      321510
tggagatgaagtggatggtgcctggatgcttcttacagacatctcaaagcagatggttctgattcttac      321580
tatgagtttaaaagtacatatacctggtatgcatataccttggaatttggatgatcacagaaaaatgat      321650
gttggaatgtgcatgtcaggaaaaattaggaagggaggatgaagggactgaaggaaggagagttgtgatg      321720
aaggaaagaaggtgaaggagggaggaaggaggagggtgggagggaaagaagagagagagagaggaagg      321790
gagggaaagaaggaaggaagaaggaagggagggaatcaagaaaggagtaaaggaagggaggaagtaagga      321860
aagaaagagggaagagggagaagagaaatgaaagatgtaagaagggaaggaaggtgaaaggaaggaaggg      321930
aggaaggaagggaggaaggaaggaagaaaagaaggaagcaaagaaaagaaagtgagagaaaagaaagaga      322000
ggaagggaggaggaagaaagaagagaggaaggaaggaaagagagattaggagagaggcaaggataaaaa      322070
tggatggagacaaaaaaagaaggaaggggaggaggaaggaaggaagagagggaagaaaaagagggaatgga      322140
ggaggagaggaagaaaggattgagggaaggggagggatgggtaaggggaaagaagaaaaacagggaaaggga      322210
gggtgagagataaagagggaagggagtagggggaggaaggaaagaaggagggagggagggacaattggat      322280
ccttgcttacaaatcatgtcacctgtatattttcatgttaatatttaggtaagaggcctcccatcttag      322350
aaaggcagattcagcaagcacacacagtacatagaaatgagaagaaagttgctgcagagctctaaaccatgaa      322420
agccttgatcaagacaggatgttgaaatcagtgaatgtcagggcctcaaataatccttgctatttttaa      322490
ttattattttgaatagggaagcaagtgcccaggcctgtgcctgagggggattctcccctgtagcaaggag      322560
gtgtttcaatgttagtccaggtcacgggactaaaatcatgcttgaagagaactgagtaagcccaaacatg      322630
caaagccattgtagaaataaggtagattaaaaccatttttgtaaatgagaagcaccatcaagcaaaagtg      322700
aaaactaactctgaggtttgaaagggctctagaaagttaaacttattttcctctaaaattatttgggaa      322770
ataggagaaaaggggtttgtctaagctgatcaataaaatgcaggtgcccattgatccaggattctctcat      322840
tttgagctctatgtggaaagagatcggcaaaaaggagtggggggaaccttggtcttttttttttttttctt      322910
ccgagacagagtctttctgtgtcacacaggctggagtgtggtggtgcgatctcatgtgatatcagctcac      322980
tgcaacctccgcctctgggttcaagcaattatcctgtctcagcatcccaagtagctgggattacaagctc      323050
ccatcagtgtacccagctaattttttattttttagtagaaacaggtttcaccatgttgtcctggtctcaaac      323120
ttctgacctcatgatctgtgcaccccagcctctcaagtgctgggattataggcttgagccactgcgccc      323190
agccaaatcttggtctcttttataagatatgacaaagagcagtgctttaaagtaatcaaacaatacattat      323260
aatatgtaatagaagaagttgtgtgctattggaagtcagaaatgggaaaagagttttgtaatggaaaatc      323330
agatcaacatgtatttttcattttttatgttgttgcactgagtctgaggcttgtacatcagattgatttct      323400
atctttttttgcatcagacaccatcactgctgttgaatgttctctattctatcgataatttatattcaacc      323470
attgctaaatctgttgaggaaaaaagaagtcccaatgaagtgtttagcagggattggttacagagagttg      323540
cagcataattctagttgtaaaggtgacccttagtaccaaaaagggatttaagctgaatgaatgaacatc      323610
ctccccctggtgtggtggaggagtcactgaatgtataataaactagtttgctaacaatgttttggatataa      323680
ggaaaacctgtactacttaaaggaacagctgagagtgttcatggatattttttagagagatcatagtacta      323750
tatccatctctagctaaagaaatcagcaagacccttagaaatgcacttgagctctccctgccaagattaca      323820
tctcaaatagaacaggtggaaatggctgtgttaggtgctaggggataaggaggaagacaggcattgagtc      323890
ttttactagagacaccaactagtgtttctatcctcagtcattacaatctttaattttactcacaggaatt      323960
taaacatttcttatgctgaataaaaactaaaaaataaaacactgatatcacacatctagacctcactgt      324030
ctgcaggggtttggtaagggagaatgacgtgggctgtcataatctccacaagcttatcagtgcttaagaat      324100
tctggctatgcatccctgagatctttaatagacagattcactcggggcagcagctcacttatctggatttc      324170
ccaaatcctctcctttattcttcaagaatacatgttttttatttattttttaaagaacagaataaatgtt      324240
ttttcttttacccttcgaatatacccctgaatccttcaaaaattgcctaatagtcaacatgaacagaatact      324310
ccttttcctagattctcactgcttagtagatgagatagccacacatctaatagacccaatttagaaaaat      324380
tggatccatgaaaaaaacgaggaatcttcacttccattgttttctttagaacactaaaaattaataacaa      324450
atattagtacgaagttttcctaaaatattattcattttattttctttcaacacacattaagtaaaaat      324520
tttataattatttcagaaggcttaaagaagcaaaagaaacatgagatgataaaatgaatccagtgttttt      324590
tcaaagccgtatcaaaatgtatgcataacaaataaaaaagcagtagacttttcaaatatattttttatgaa      324660
taaatatgagatctcatggtattcaaacttatgtgatttttatatatatatttgtttcaccctcttagta      324730
acgtgaaagcacggcagttagtgtgcattcaagtaaaaggtagaggtcaacattcttttttcttctctatt      324800
acattatacatcttatatctgtatctatagatagatatacatgtacacatatgtacatatgttatacata      324870
catatatatactgcatatatgtatatggttagtatacagtataaactctggtacacagtatacttatatat      324940
agtatgtaatatacagtataccattatatactctataatgtacataatatagaattatagtatgtactat      325010
gatacacagtatatcactccatcactccctagttccccctcccttgcaatattgtaggtgttctaattttt      325080
tatattggaagagaagggataatatttcctgaattcttaccatatgtcagacattttgtcattatcttc      325150
```

```
aaccttcatcacgtgtctccaagcctgatattcttattctctatgtagatgggtaagttaaggccaacag       325220
tggctggaaaatttgctcaatatttcacagctgttaatgagccagagcttcagaaatttgaatacaggga       325290
cattatttcctttacgaccaccacagactcagattgaggggagaaaatcttcctttatcacatgtggcat       325360
ctctgagtcaagtatattgttcaaatcctgcacaatatctgacaatgactagacatatgctcttccttgg       325430
tcctgtagccttctgccatacaggtcaatatgcaatggttggaggcaacttcacaaaagtcccccctaagg     325500
aggagttacctggaggatggactttagattacacctggaaccattgatcaggatgttgcaactccctgcc      325570
tgcctgggtctgcacattacatctcaatgctgagtactaaccattagatgacattttaccatgcacaatc      325640
tcaatttttgtaacaattaaaccttaagatgtaattggttttatagcttactttatcaaccataaggaa       325710
aggtagaaatgagaatttggtatatttgtttttgaaggggaagtgttatcttaaagggttagttgcaa        325780
agatgtttaaaggctctatgctttatgaattatctccaaatttttatgattctccttctacctctgccca      325850
cttgtgcaaataataagataattcttcagtgtatagcttccaagcacaatttagcatctgcagcagc         325920
cctcagcttgtttctgggtgtcttatttatactaaatatgttaaccttggcgtaaatatatgtaccattt     325990
taacaaacttcttacagctgctgtaatgtgctttcatcttttctggactctgtcttcaaaaattgtccac     326060
gtgtgtatgtatttcacttcaaatagagagcaaacaaatgatgcatgtgttgacttgcagcttttaatt     326130
ataaatcctattttatttgagtgttaatatcaattttcattgctgtaactgcaatatctgttcatttac     326200
ttcaaatgcaattattgagtaagaaagagaatgcccacttgttcaaaaattcttaatcagaattctcag     326270
cctgagtactgttaacatttgggtccagataacttctttgctgtggggtctctccagtgcaccagaggg     326340
tgtttagtagcatccctaacctccacccttcataggaactgccctctgtctacaaaaaccaaaaatgtct     326410
ccagaccttcccaaatacccctctggggcaaatcactcctggatgagttttgcagttcagaaacagtgaa     326480
acttgaaatactgaaatttttcccagagacacttagttttcctttatttttgaagatcatttgatgcatt     326550
aaaaaatagtaaacatgttataaaaattgaataatgatgctgtcaggatttatatttaaaagaaaaataa     326620
gagcaattttaaaggaaaagacaacatgatagacatgcctaggatgaaagcagaatgtacctttgctgc      326690
ttgggtatttgtgctcattgataaatatatatgaagagcagattgtaacttcctgatttattggtttaa     326760
gataatttcatatcacatgtggaagaatatgacctttctttttttcttccttctatcccagTGATCCAA     326830
ACCAACCAGTTCCTCAGGATACCAAGTTCATTCATACAAAACCCAATCGCTTTGAAGAAGTGGCCTGGTC       326900
CAAGTATAATCCCAAAGACCAGCTCTATCTGCATATTGGCTTGAAACCCAGAGTGAGAGATCACTACCGG       326970
GCAACGAAAGTGGCTTTCTGGTTGGAATTGGTTCCTCATTTGCACAACTTGAACGAGATATTCCAGTATG      327040
TTTCAACAACCACAAAGGTTCCTCCACCAGACATGACATCATTTCCCTATGGCACCCGGCCGATCTCCCGC     327110
CAAGATATGGCCAACCACCAAACGCCCAGCAATCACTCCTGCCAACAATCCCAAACACTCTAAGGACCCT     327180
CACAAAACAGGGCCCGAGGACACAACTGTCCTCATTGAAACCGGAGATTATTCCACGGAATTAAGTG        327250
TCACCATTGCCGTCGGGGCGTCGCTCCTCTTCCTCAACATCTTAGCCTTTGCGGCGCTGTACTACAAAAA      327320
GGACAAGAGGCGCCATGAGACTCACAGGCACCCCAGTCCCAGAGAAACACCACAAATGATATCACTCAC       327390
ATCCAGAACGAAGAGATCATGTCTCTGCAGATGAAGCAGCTGGAACACGATCACGAGTGTGAGTCGCTGC      327460
AGGCACACGACACGCTGAGGCTCACCTGCCCTCCAGACTACACCCTCACGCTGCGCCGGTCGCCGGATGA     327530
CATCCCATTTGATGACGCCAAACACCATCACCATGATTCCAAACACATTGATGGGGATGCAGCCTTTACAC     327600
ACTTTTAAACCTTCAGTGGAGGACAAAACAGTACAAATTTACCCCACGGACATTCCACCACTAGAGTAT      327670
AGcttttccctatttccctctatccctctgccctactgctcagcaatgtaaaagagacaaataagga       327740
gaaagaaaatctccaaaccaggaatgtttttgtgccactgactttagataaaaatgcaaaagggcagtca     327810
tcctgtcccagcagaccettctcattggcatttccagtattgtgagatcaatttctgaccatatgaaat      327880
gtgaaaagtatatgtttctgttacaatactgctttaagatctaaaccatgccaacagatgtttcgtgtga     327950
ctaggacatcaccattccaaggaactgtgtgtttccaacatcatggtagcagcacacacttccaaagctc     328020
agccagggacacttaatatttttaattacaatggaaatttaaacattttttatgtgtgggtacacaatgga    328090
tggctcttcttaagtgaagaaagactctataggcttttacacagcacatgaagcagtaatccagaaagaa     328160
ggaaatgcagaattttattatcaaagtaagcgaattgactgtgcagaaaaattgtagggtctgtggaag     328230
gaggtattctgccagcctgaactatatttaagaaactttgtaaaaataaaaatgtatatagctgtgagc     328300
tcaaacaaaactgcagacaaacaaaaagagaaaagcttttatttgttttcagtttgaaagaactt        328370
tagcaaggttgtgctttcaaacacatattgtcctaccaccttagttctctacagcaaaagaggcttt        328440
cttcttaattacatgtaaacaaagacatgggattttctgacgtaagattttcatttgtaggaatatgtga     328510
tgtcaaatggaagactcagaagtttgtgtggcctattctccctgtcaggttgcacagatgcatgtaga      328580
gcattcttaggagaccattgttttagaaaactttgatttgtacatgttagttttcatgaaattgcaacac     328650
agagataggtcctaaaagtggaatgtatttaaaacttgttgaattagacacacacacagacacacaca      328720
aagaatcagcagagaaaacaaaatacaagtcctgttctgtagttcttgcccttttgaatatatttgggaag    328790
agttgcttcctatttcaggaccctgccaaaaaagaagaaagcttgcctttggtggggctatgccccttgg     328860
agtaaatacagctctgtgttccctagcagctgccggaggatttggctgatgaagtacctgctcagcttag     328930
ctaatcagattaaaggaagacatgtatgtcttttgtttaagcacctagtccccttatgtatcagtaaacag     329000
gttttttaaaaatctttttatgtcatttataggataaaacatatgctgtctgaaaatatcaccttttgtgg     329070
atttatctgatcaccaaataataaatattaagaagaatgggggaaaaaggatagaatattaaaactgctt     329140
tgcataggttttttgggaaattaggatatcttcactgacaagcactgaatggaattttattcacccattt     329210
taaattggttacttggggatcagagatttgtctctccaacagcttgtggttttcttattactcattttca     329280
ggaaagtttgtagtattacaaggcagaaggaaacacagtagcaatggttgctctatattttgtctttcaa      329350
agattactgcattaccaagaaacagtagccaaagatgtttgaagatcatgtccctagctgcattgtggg      329420
ttattctagaaatccaatgttaaatgcctctactaaagtggggattcccccataaaaattgtccagctacc    329490
tgactcttttgcaataacaactttgattactgaatccatacactcaaactatagtgatatatcagtgttt     329560
gggagtgacctctagaaaaagaaaactgttttagaaatacataaaatcacttccaaatcctgttgctt      329630
atgttgggttaaatttgaaagcaattctctatatataaatatgtgaaatattatgatctgaacttagcac     329700
acatgaagcaacatttctttgctacacagaggtgtcttggaaagatttcattcccaattcattttcata     329770
gatctataatcaggcaatttctgcaagcaatgtatgaccccacctgagcaaccacaaataggctctccat     329840
gaaactgcaaaggaactgatgtgtggcatccatgctggttttgtctgtctataatatgaattcaagtatc    329910
tgttcatatttccaattgtctcctgctagcaatatgtgccacaacatgaagtcttgtgacatcttaagg    329980
aaaagaagagttcctgttaaatgaatagctttagcttttacaggggattatgattaaaagtgatttagta     330050
catcttacatgatatcttcatttctacgtgaaagtttatagaatcttcatagagttccatgagaaaa        330120
tatacttgctatttataagaaacgagaaaaaagaaaaaaatgagaaacaagtaagaaaaaatcctttcct    330190
aggcttttccttgatcttcagaggcacacagggttaatggttccttaggttattattttgaggttttgt     330260
```

FIGURE 11A-65

```
tctttcttttgccttaagtaatgacagaagatatatatggccagacacatatgtataaacttttcagcag      330330
cattttaataataaaatatcacactatttctaatgctttgtacaaacaattatgcatctgttctttctt      330400
ggtaggtggaatattttatttacttttgccattctttgaatgccttttctttgtaaatgctacatggta      330470
gctctcacataggctacaaatggataaatacatttggtaatgggatggtttctttagctttggccagctg    330540
cacagttgaggaggctctgctggcctgattttggaaaaccaagccctgtttggtgaagctcctgagatga    330610
cactgcctgaaaatgagtatttggttgtgttatttctaccactgttcattcttgtgtctctgtgttttga    330680
tttgtgttcaacaaactgatgccttaatggtttcaaatagaaagcctaggtgagtaaaccttctagtga     330750
cagtaagaaattctactgaatgaaactccagaggcagaaaatcattgtcattccaatgggagctcaattg    330820
tcaattccttcctgtgcattcagccatcacgaacttatttcacattcacagtagctctaaggggcaggca    330890
cctgcattactccccttcataatggaagatgttctgactttgaaacatgccccttggacaggaaaatt     330960
tgatggataacaggatagcatatcctcatatcccaatcttcaccaagaagttatacagcaaacacttgt     331030
aagtcaaggtcttgcatgataatctttgctaagtagcaagtaaagaaatatagcaaggacccagactctt    331100
tggaatatgtgaactaaatccttcagatgttgttggcctcaatcatgttgtgaaggcacacaggagaata    331170
catacacacacatatgcatatatgtatatatgtacatgtatgtgtacattatatgagtatacatgtac     331240
ctatcctatatatgtatgtatgtatagagtcacagactgcataatgttttggacaaatatagatcacata    331310
tatgatgatagtgtcttgagattaaaataccatgtttttattgtacctttcagtgttcagatatgttta    331380
gacaaacaaatgcttatcattgtgttacagttgcctaaggtcttctctccagtcacatgctgtacaggtt    331450
tgtagactggaagaactaggctataccatagagcctaggtgtgctataggctacacatcggttttgtgta    331520
agtatactacatgatgtttgcacaatgatgaaattgcctaacgaaacttttctcagaaacctattgatac    331590
atgactgtgtatgtttacattatatatactgtatatgcacacatgcatatatgcatatatgttataca     331660
tttacatatgtacatggatatcacatactttaaattcctgaagatgtcattttcattaaatacatatgca    331730
cacacactcataaacacacacagactcatatatacacacaaatctataacacatttgtgctcacatatac    331800
attcctctgtgtgtgtgtgtattacattactgcttttatctgtgaaatcacattctgcagtttcatt      331870
tactgtgatcaactatgatctaaaaatatatgagtacttcaataagtatttttgaaagaaaccacattca    331940
cataacatttatgacattataattgttctattttattagctattgttcatctcttactccatctacttta    332010
taaattaagcttcataataagtgtgtatatttaataaaatatatagtatataaagggtttggtactatct    332080
gtggtttcaggtatccactgggagtcttggaatgcattctttttggaaaaggagcgttacactatatact    332150
tacatatagacacagatgcatatatacacatacataatttacatatatagacatattcgcagatatgaat    332220
gtacttaaatctctaagaatggcactttttattaaatgtacacaaataaacatgtatacacatacatatat    332290
atatatatatatatacacacacacacatttaactgatgtcatcttcaggcattcaaagcctaattt       332360
tagcaaatttcagctggagggagaatcactcttgttttgactattttatgcattcttgttcatttgaat    332430
aactcaaggaatgctaaaaattatatgcatccattcagtgaaactttactgaatatcttcactgcctcag    332500
gccctgtgctgggctggtgttaaaattgaagaacaaacttctcacaccacaaacttgaggggaaggcag    332570
agaaacacagaagcaaggagaggcaaggggtgctggagatggcacccatgttaataaggggtgctaataa    332640
atgtctggacactgccccttaacctagtctgggaagatcaggaatacattctgtctgaagaaacccctaag    332710
ccaggtctttccaactctgtagaaaaatactagtgggtggtgtgttgtggggaggatagaattacacat    332780
ctttgaagtaagaagacagacgaagacataggaagacatggctcctgcatcatgggtgaaaaatataagg    332850
tgtttttagaaaggtgtgaaaaatgagacagaaagaaattggctgataaaaaacctccaacaaatgaga    332920
cagaaaggaactggctgataaaaaaacctccaactgcaagacaggggagtttgggctttgtcctgaagtca   332990
attgagagacaccaaatgattgcaccaaagtggattatgagtgtatttagttgagacatttagcagtaat    333060
tctcaaaagttcacatgcttaggaatacacgggatgtcaacttaaagtacagatccttactgaattgtgg    333130
tttggtgaacctgtgtctgaatttccaagacgatctctaagtgatgcacttgttgctcattctcaattaa    333200
cccaacttatttaggttgcaaaggatggagaactgttcactttagaagtaaccatgaggataatctgca    333270
ttggaatgagaggggttctggatgcaaggacaagcagaaattaaagagccagaacaatcagaattaattactgtc    333340
ctctttttaagggtgatggagaccgtaataagacaagaagtaaaaaagaaaaaaaaaacgataagaaatg    333410
catcttatagctgcatgtaccagaactgataaagcgtagtcatcaaaaaccacctggaaccacatttgtc    333480
cttaagctttgtgtttaggaacttgtttcaacagagagaggagaatgatgagataccttggagagagtttc   333550
agacaggctggtcaagggtttgggcttagactgggttgttttataagtgctaagagggccaaaaacttgt    333620
tcctgcattggttactgtcatgataatggggatgtcaatatcctttagcaagaaagtgacaggaccagag    333690
aatgactagcattgtcttcagtaaaaataagcagtggaagagaaggggattgggtcattttcagtgtt     333760
tccagactgttcatgtttctggcttgtcccatgctggccgtgggctgccttcatctaatgaggaagttcg    333830
ttcaattattttatgtgcagccagatgcaccttgacttagcaattaattatcaggctaattctagcagc    333900
cagatataagggctgttttttgttgtttctcagaacttccaggaaatatatgcatatgtcacatctccta    333970
ggccaccctggttcaaaaaaaaaaaagttatgctaagaagtaaaagtgatactttctctgcaaaatctt    334040
attaatatattgaaagaaattgagatataaaaaggtccactgtacctctacctttctctaaaatgatca    334110
tacatgtaaattcttagaacacccacaaataatctggtttcctctactggcaaaagaattagaaaaaaaa    334180
aaatgagaaaattagccaggagaaaaccctgcctgaaattaacaggtgacattcattaaagtggaatgt    334250
tccaactagttctcaaagtcactgattcctaaaagggccggaagggagtccttggagactaagacaaat    334320
tgccaacagccatagctggaaggttacaaaaagaaaaatctttctcaccccgggccctaaacacaaga     334390
acttggactcagcagaaaggaagtgggaagatgcatttctggcacaccaaaatataaacctaacaactcc    334460
tgtaaaaactgagaaatcagatggtgcccaatttataatattagagccactattacgcttcagtggtaca    334530
attggtcaaactggtttcttgtgggctcagatgttagcttcattttatgcaacacctgtttctacaagt    334600
atatacgttatgatcacagctttcaaactaacatgcttggcctgcctgggttattggatgttatttctag    334670
tatttaaagagcaattacagttttagattataataatagaaaagcacataacaatttataagtatatgc    334740
attacctacagacaaacttttcaaataaatgtttaagagattttgtaaaagcattgattcaaccatttac    334810
agagcaatcacttgtttcaagttttaaaactttcagataatcatcaaaatgtattgttctgcgtaagtta    334880
tatgcattaagtcatttaatccttttactagttccagggtgcagactctcatttttacagatgaggaact    334950
ggggtacagaaaattaaataaattgctcaaggttgcagacttagaacataaaatttatagcgttcacaat    335020
catattgttttgtttttaagagcatgtgcttgtcaactattctctaaaaaacctggttattgcagaaata    335090
tatgcctccctgtagacattttgggggaagaaaaaaatcactataatctgttgtagagaacattgatagc    335160
tttatatcttaaaaaacttgtcatgtacacacacacaaac                                  335199
```

FIGURE 11A-66

>HNL4Y cDNA (SEQ ID NO:5)

Exon 1 (1-153)
Exon 2 (154-724)
Exon 2bis (725-784)
Exon 3 (785-937)
Exon 3bis (938-1048)
Exon 3ter (-)
Exon 4 (1049-1234)
Exon 5 (1235-2024)
Exon 6 (2025-5338)

ORF (253-2871)

```
tttttttcccttccttcatctcctggcctcggataagataaggcttgggggatgcacgaaataatccaagtgattgatta
gacctggcatggcttggttgggctggagaaagatcggggcgcgctggaaacccgcgtgaagatgaaatgacttttcga
aagacttatctttctgcaggctcgcctctgagctttgtctccttggagccacctcacttagacagcttcggatgtggatg
cagatttgaaccATGTTGCGTCCCCAGGGACTGCTATGGCTCCCTTTGTTGTTCACCTCTGTCTGTGTCATGTTAAACTC
CAATGTTCTTCTGTGGATAACTGCTCTTGCCATCAAGTTCACCCTCATTGACAGCCAAGCACAGTATCCAGTTGTCAACA
CAAATTATGGTAAAATCCAGGGCTAAGAACACCATTACCCAGTGAGATCTTGGGTCCAGTGGAGCAGTACTTAGGGGTC
CCCTATGCCTCACCCCCAACTGGAGAGAGGCCGGTTTCAGCCACCAGAATCCCCATCCTCCTGGACTGGCATCCGAAATGC
TACTCAGTTTTCTGCTGTGTGCCCCCAGCACCTGGATGAAAGATTCTTATTGCATGACATGCTGCCCATCTGGTTTACCA
CCAGTTTGGATACTTTGATGACCTATGTTCAAGATCAAAATGAAGACTGCCTTTACTTAAACATCTATGTGCCCATGGAA
GATGGAACCAACATAAAGAGAAATGCAGACGATATAACCAGTAATGACCATGGTGAAGATAAAGATATTCATGAACAGAA
CAGTAAGAAGCCTGTTATGGTCTATATCCATGGGGGATCTTACATGGAGGGAACCGGTAACATGATTGATGGCAGCATTT
TGGCCAGCTATGGGAACGTCATCGTTATCACCATTAACTACCGTCTGGGAATACTAGCACAAAACACCCTGGCTCATGGA
AACTGCAAGCATCGTTGTCAGCTGCACCTGCAGGCACCACGGGATTGCAAGTCAGCATACCCTTTCAGAAATGAGGATGA
AATTAGAGGGTTTTTAAGTACCGGTGACCAGGCAGCAAAAGGCAACTATGGGCTCCTGGATCAGATTCAAGCACTGAGGT
GGATTGAGGAGAATGTCGGAGCCTTTGGCGGGGACCCCAAGAGAGTGACTATCTTTGGCTCGGGGGCTGGGGCCTCCTGT
GTCAGCCTGTTGACCCTGTCCCACTACTCAGAAGGTCTCTTCCAGAAGGCCATCATTCAGAGCGGCACTGCCCTGTCCAG
CTGGGCAGTGAACTACCAGCCGGCCAAGTACACTCGGATATTGGCAGACAAGGTCGGCTGCAACATGCTGGACACCACGG
ACATGGTAGAATGTCTGAAGAACAAGAACTACAAGGAGCTCATCCAGCAGACCATCACCCCGGCCACCTACCACATAGCC
TTTGGGCCGGTGATCGACGGCGACGTCATCCCAGACGACCCCCAGATCCTGATGGAGCAAGGCGAGTTCCTCAACTACGA
CATCATGCTGGGCGTCAACCAAGGGGAAGGCCTGAAGTTCGTGGACGGCATCGTGGATAACGAGGACGGTGTGACGCCCA
ACGACTTTGACTTCTCCGTGTCCAACTTCGTGGACAACCCTTTACGGCTACCCTGAAGGGAAAGACACTTTGCGGGAGACT
ATCAAGTTCATGTACACAGACTGGGCCGATAAGGAAAACCCGGAGACGCGGCGGAAAACCCTGGTGGCTCTCTTTACTGA
CCATCAGTGGGTGGCCCCGCCGTGGCCACCGGCCGACCTGCACGCGCAGTACGGCTCCCCCACCTACTTCTATGCCTTCT
ATCATCACTGCCAAAGCGAAATGAAGCCCAGCTGGGCAGATTCGGCCCATGGCGATGAAGTCCCCTATGTCTTCGGCATC
CCCATGATCGGTCCCACAGAGCTCTTCAGTTGTAATTTCTCCAAGAACGACGTCATGCTCAGTGCCGTGGTGATGACCTA
CTGGACGAACTTCGCCAAAACTGGTGATCCAAACCAACCAGTTCCTCAGGATACCAAGTTCATTCATACAAAACCCAATC
GCTTTGAAGAAGTGGCCTGGTCCAAGTATAATCCCAAAGACCAGCTCTATCTGCATATTGGCTTGAAACCCAGAGTGAGA
GATCACTACCGGGCAACGAAAGTGGCTTTCTGGTTGGAATTGGTTCCTCATTTGCACAACTTGAACGAGATATTCCAGTA
TGTTTCAACAACCACAAAGGTTCCTCCACCAGACATGACATCATTTCCCTATGCACCCCGGCGATCTCCCGCCAAGATAT
GGCCAACCACCAAACGCCCAGCAATCACTCCTGCCAACAATCCCAAACACTCTAAGGACCCTCACAAAACAGGGCCCGAG
GACACAACTGTCCTCATTGAAACCAAACGAGATTATTCCACCGAATTAAGTGTCACCATTGCCGTCGGGGCGTCGCTCCT
CTTCCTCAACATCTTAGCCTTTGCGGCGCTGTACTACAAAAAGGACAAGAGGCGCCATGAGACTCACAGGCACCCCAGTC
CCCAGAGAAACACCACAAATGATATCACTCACATCCAGAACGAAGAGATCATGTCTCTGCAGATGAAGCAGCTGGAACAC
GATCACGAGTGTGAGTCGCTGCAGGCACACGACACGCTGAGGCTCACCTGCCCTCCAGACTACACCCTCACGCTGCGCCG
GTCGCCGGATGACATCCCATTTATGACGCCAAACACCATCACCATGATTCCAAACACATTGATGGGGATGCAGCCTTTAC
ACACTTTTAAAACCTTCAGTGGAGGACAAAACAGTACAAATTTACCCCACGGACATTCCACCACTAGAGTATAGcttttc
cctatttcccctcctatccctctgccctactgctcagcaatgtaaaagagacaaataaggagaaagaaatctccaaac
caggaatgttttgtgccactgactttagataaaaatgcaaagggcagtcatcctgtcccagcagaccttctcattgg
cattttccagtattgtgagatcaatttctgaccatatgaaatgtgaaaagtatatgtttctgttacaatactgctttaag
atctaaaccatgccaacagatgtttcgtgtgactaggacatcaccatttcaaggaactgtgtgtttccaacatcatggta
gcagcacacacttccaaagctcagccagggacacttaatatttttaattacaatggaaatttaaacatttttatgtggg
ctacacaatggatggctcttcttaagtgaagaaagactctataggcttttacacagcacatgaagcagtaatccagaaag
```

FIGURE 12

```
aaggaaatgcagaatttttattatcaaagtaagcgaattgactgtgcagaaaaattgtagggttctgtggaaggaggtatt
ctgccagcctgaactatatttaagaaactttgtaaaaaataaaaatgtatatagctgtgagctcaaacaaaaactgcaga
caaacaaaaagagaaaagcttttatttgtgttttcagtttgaaagaacttttagcaaggttgtgctttcaaacacatat
tagtcctaccaccttagttcctctacagcaaaagaggcttttcttcttaattacatgtaaacaaagacatgggattttct
gacgtaagatttcattgtaggaatatgtgatgtcaaatggaagactcagaagttttgtgtggcctatttctccctgtc
aggttgcacagatgcatgtgagcattcttaggagaccattgttttagaaaactttgatttgtacatgttagttttcatg
aaattgcaacacagagataggtcctaaaagtggaatgtatttaaaacttgttgaattagacacacacacacagacacaca
caaagaatcagcagagaaaacaaaatacaagtcctgttctgtagttcttgcccttgaatatattgggaagagttgctt
cctatttcaggaccctgccaaaaaagaagaaagcttgcctttggtggggctatgccccttggagtaaatacagctctgtg
ttccctagcagctgccggaggatttggctgatgaagtacctgctcagcttagctaatcagattaaaggaagacatgtatg
tcttttgtttaagcacctagtcccttatgtatcagtaaacaggtttttaaaaatctttatgtcatttataggataaaac
atatgcttgtctgaaaatatcaccttttgtggatttatctgatcaccaaataataaatattaagaagaatgggggaaaaa
ggatagaatattaaaactgctttgcataggttttggggaaattaggatatcttcactgacaagacactgaatggaattt
attcacccattttaaattggttacttggggatcagagatttgtctctccaacagcttgtggtttcttattactcattt
caggaaagtttgtagtattacaaggcagaaggaaacacagtagcaatggttgctctatattttgtctttcaaagattact
gcattaccaagaaacagtagccaaagatgtttgaagatcatgtcccttagctgcattgtgggttattctagaaatccaat
gttaaatgcctctactaaagtgggattccccataaaaattgtccagctacctgactcttttgcaataacaactttgatt
actgaatccatacactcaaactatagtgatatatcagtgtttgggagtgacctctagaaaaaagaaaactgtttttagaa
atacataaaatcacttccaaatcctgttgcttatgttggttaaatttgaaagcaattctctatatataaatatgtgaaa
tattatgatctgaacttagcacacatgaagcaacatttctttgctacacagaggtgtcttggaaagatttcattcccaat
tcattttcatagatctataatcaggcaatttctgcaagcaatgtatgaccccacctgagcaaccacaaataggctctcc
atgaaactgcaaaggaactgatgtgtggcatccatgctggttttgtctgtctataatatgaattcaagtatctgttcata
tttccaattgtctcctgctagcaatatgtgccacaacatgacagtcttgtgacatcttaaggaaaagaagagttcctgtt
aaatgaatagctttagcttttacaggggattatgattaaaagtgatttagtacatcttacatgatatctcatttctacgt
gaaaagaagttatagaatcttcatagagttccatgagaaaaatatacttgctatttat
```

FIGURE 12(continuing)

>HNL4Y protéine (SEQ ID NO:6)

Signal peptide (1-43)
Esterase domain (44-654)
Transmembrane domain (732-753)
Required for binding to PDZ domains (871-873)
Extracytoplasmique domain (1-731)
Intracytoplasmique domain (754-873)

```
MLRPQGLLWLPLLFTSVCVMLNSNVLLWITALAIKFTLIDSQAQYPVVNTNYGKIQGLRTPLPSEILGPVEQYLGVPYAS
PPTGERRFQPPESPSSWTGIRNATQFSAVCPQHLDERFLLHDMLPIWFTTSLDTLMTYVQDQNEDCLYLNIYVPMEDGTN
IKRNADDITSNDHGEDKDIHEQNSKKPVMVYIHGGSYMEGTGNMIDGSILASYGNVIVITINYRLGILAQNTLAHGNCKH
RCQLHLQAPRDCKSAYPFRNEDEIRGFLSTGDQAAKGNYGLLDQIQALRWIEENVGAFGGDPKRVTIFGSGAGASCVSLL
TLSHYSEGLFQKAIIQSGTALSSWAVNYQPAKYTRILADKVGCNMLDTTDMVECLKNKNYKELIQQTITPATYHIAFGPV
IDGDVIPDDPQILMEQGEFLNYDIMLGVNQGEGLKFVDGIVDNEDGVTPNDFDFSVSNFVDNLYGYPEGKDTLRETIKFM
YTDWADKENPETRRKTLVALFTDHQWVAPAVATADLHAQYGSPTYFYAFYHHCQSEMKPSWADSAHGDEVPYVFGIPMIG
PTELFSCNFSKNDVMLSAVVMTYWTNFAKTGDPNQPVPQDTKFIHTKPNRFEEVAWSKYNPKDQLYLHIGLKPRVRDHYR
ATKVAFWLELVPHLHNLNEIFQYVSTTTKVPPPDMTSFPYGTRRSPAKIWPTTKRPAITPANNPKHSKDPHKTGPEDTTV
LIETKRDYSTELSVTIAVGASLLFLNILAFAALYYKKDKRRHETHRHPSPQRNTTNDITHIQNEEIMSLQMKQLEHDHEC
ESLQAHDTLRLTCPPDYTLTLRRSPDDIPFMTPNTITMIPNTLMGMQPLHTFKTFSGGQNSTNLPHGHSTTRV
```

FIGURE 13

HNL4Y cDNA (SEQ ID NO:7)

Exon 1 (1-153)
Exon 2 (154-724)
Exon 2bis (725-784)
Exon 3 (785-937)
Exon 3bis (938-1048)
Exon 3ter (1049-1170)
Exon 4 (1171-1356)
Exon 5 (1357-2146)
Exon 6 (2147-5460)

ORF (253-1074)

```
ttttttcccttccttcatctcctggcctcggataagataaggcttgggggatgcacgaaataatccaagtgattgatta
gacctggcatggcttggttgggctggagaaagatcggggcgcgctggaaaccccgcgtgaagatgaaatgactttttcga
aagacttatctttctgcaggctcgcctctgagctttgtctccttggagccacctcacttagacagcttcggatgtggatg
cagatttgaaccATGTTGCGTCCCCAGGGACTGCTATGGCTCCCTTTGTTGTTCACCTCTGTCTGTGTCATGTTAAACTC
CAATGTTCTTCTGTGGATAACTGCTCTTGCCATCAAGTTCACCCTCATTGACAGCCAAGCACAGTATCCAGTTGTCAACA
CAAATTATGGTAAAATCCAGGGCCTAAGAACACCATTACCCAGTGAGATCTTGGGTCCAGTGGAGCAGTACTTAGGGGTC
CCCTATGCCTCACCCCCAACTGGAGAGAGGCGGTTTCAGCCACCAGAATCCCCATCCTCCTGGACTGGCATCCGAAATGC
TACTCAGTTTTCTGCTGTGTGCCCCCAGCACCTGGATGAAAGATTCTTATTGCATGACATGCTGCCCATCGGTTTACCA
CCAGTTTGGATACTTTGATGACCTATGTTCAAGATCAAAATGAAGACTGCCTTTACTTAAACATCTATGTGCCCATGGAA
GATGGAACCAACATAAAGAGAAATGCAGACGATATAACCAGTAATGACCATGGTGAAGATAAAGATATTCATGAACAGAA
CAGTAAGAAGCCTGTTATGGTCTATATCCATGGGGGATCTTACATGGAGGGAACCGGTAACATGATTGATGGCAGCATTT
TGGCCAGCTATGGGAACGTCATCGTTATCACCATTAACTACCGTCTGGGAATACTAGCACAAAACACCCTGGCTCATGGA
AACTGCAAGCATCGTTGTCAGCTGCACCTGCAGGCACCACGGGATTGCAAGTCAGCATACCCTTTCAGAAATGAGGATGA
AATTAGAGATGGAGTGTTGCTCTGTCACCCAGGCTGAagtgcagtggcatgatcttggctcactgcaacctctgcttccc
aggttcaagcaattcttctgcctcagcatcctgagtagctgaaattacagggttttttaagtaccggtgaccaggcagcaa
aaggcaactatgggctcctggatcagattcaagcactgaggtggattgaggagaatgtcggagcctttggcggggacccc
aagagagtgactatctttggctcggggctggggcctcctgtgtcagcctgttgaccctgtcccactactcagaaggtct
cttccagaaggccatcattcagagcggcactgccctgtccagctgggcagtgaactaccagccggccaagtacactcgga
tattggcagacaaggtcggctgcaacatgctggacaccacgacatggtagaatgtctgaagaacaagaactacaaggag
ctcatccagcagaccatcacccccggccacctaccacatagcctttgggccggtgatcgacggcgacgtcatcccagacga
cccccagatcctgatggagcaaggcgagttcctcaactacgacatcatgctgggcgtcaaccaaggggaaggcctgaagt
tcgtggacggcatcgtggataacgaggacggtgtgacgcccaacgactttgacttctccgtgtccaacttcgtggacaac
ctttacggctaccctgaagggaaagacactttgcgggagactatcaagttcatgtacacagactgggccgataaggaaaa
cccggagacgcggcggaaaaccctggtggctctctttactgaccatcagtgggtggccccgccgtggccaccgccgacc
tgcacgcgcagtacggctcccccacctacttctatgccttctatcatcactgccaaagcgaaatgaagcccagctgggca
gattcggcccatggcgatgaagtccccctatgtcttcggcatccccatgatcggtcccacagagctcttcagttgtaattt
ctccaagaacgacgtcatgctcagtgccgtggtgatgacctactggacgaacttcgccaaaactggtgatccaaaccaac
cagttcctcaggataccaagttcattcatacaaaacccaatcgctttgaagaagtggcctggtccaagtataatcccaaa
gaccagctctatctgcatattggcttgaaacccagagtgagagatcactaccgggcaacgaaagtggctttctggttgga
attggttcctcatttgcacaacttgaacgagatattccagtatgtttcaacaaccacaaaggttcctccaccagacatga
catcatttccctatggcacccggcgatctcccgccaagatatggccaaccaccaaacgcccagcaatcactcctgccaac
aatcccaaacactctaaggaccctcacaaaacagggcccgaggacacaactgtcctcattgaaaccaaacgagattattc
caccgaattaagtgtcaccattgccgtcggggcgtcgctcctcttcctcaacatcttagcctttgcggcgctgtactaca
aaaaggacaagaggcgccatgagactcacagtgcaccccagtcccagagaaaaccacaaatgatatcactcacatccag
aacgaagagatcatgtctctgcagatgaagcagctggaaacgatcacgagtgtgagtcgctgcaggcacacgacacgct
gaggctcacctgccctccagactacaccctcacgctgcgccggtcgccggatgacatcccatttatgacgccaaacacca
tcaccatgattccaaacacattgatggggatgcagcctttacacacttttaaaaccttcagtggaggacaaaacagtaca
aatttaccccacggacattccaccactagagtatagcttttccctattttcccctcctatccctctgccctactgctcag
caatgtaaagagacaaataaggagaaagaaatctccaaaccaggaatgttttgtgccactgactttagataaaaatg
caaaggggcagtcatcctgtcccagcagaccttctcattggcattttccagtattgtgagatcaatttctgaccatatg
aaatgtgaaagtatatgtttctgttacaatactgctttaagatctaaaccatgccaacagatgtttcgtgtgactagga
catcaccatttcaaggaactgtgtgtttccaacatcatggtagcagcacacacttccaaagctcagccagggacacttaa
tatttttaattacaatggaaatttaaacatttttatgtgggctacacaatggatggctcttcttaagtgaagaaagact
ctataggcttttacacagcacatgaagcagtaatccagaaagaaggaaatgcagaattttattatcaaagtaagcgaatt
```

FIGURE 14

```
gactgtgcagaaaaattgtagggttctgtggaaggaggtattctgccagcctgaactatatttaagaaactttgtaaaaa
ataaaaatgtatatagctgtgagctcaaacaaaaactgcagacaaacaaaaaagagaaaagctttta tttgtgttttcag
tttgaaagaacttttagcaaggttgtgctttcaaacacatattagtcctaccaccttagttcctctacagcaaaagaggc
ttttcttcttaattacatgtaaacaaagacatgggatttctgacgtaagattttcatttgtaggaatatgtgatgtcaa
atggaagactcagaagttttgtgtggcctatttctccctgtcaggttgcacagatgcatgtagagcattcttaggagacc
attgttttagaaaactttgatttgtacatgttagttttcatgaaattgcaacacagagataggtcctaaaagtggaatgt
atttaaaacttgttgaattagacacacacacacagacacacacaaagaatcagcagagaaaacaaaatacaagtcctgtt
ctgtagttcttgccctttgaatatatttgggaagagttgcttcctatttcaggaccctgccaaaaaagaagaaagcttgc
ctttggtggggctatgccccttggagtaaatacagctctgtgttccctagcagctgccggaggatttggctgatgaagta
cctgctcagcttagctaatcagattaaaggaagacatgtatgtcttttgtttaagcacctagtcccttatgtatcagtaa
acaggttttaaaaatcttttatgtcatttataggataaaacatatgcttgtctgaaaatatcaccttttgtggatttat
ctgatcaccaaataataatattaagaagaatgggggaaaaaggatagaatattaaaactgctttgcataggttttggg
gaaattaggatatcttcactgacaagacactgaatggaatttattcacccatttttaaattggttacttggggatcagaga
tttgtctctccaacagcttgtggttttcttattactcatttcaggaaagtttgtagtattacaaggcagaaggaaacac
agtagcaatggttgctctatattttgtctttcaaagattactgcattaccaagaaacagtagccaaagatgtttgaagat
catgtcccttagctgcattgtgggttattctagaaatccaatgttaaatgcctctactaaagtggggattccccataaaa
attgtccagctacctgactcttttgcaataacaactttgattactgaatccatacactcaaactatagtgatatatcagt
gtttgggagtgacctctagaaaaaagaaaactgtttttagaaatacataaaatcacttccaaatcctgttgcttatgttg
ggttaaatttgaaagcaattctctatatataaatatgtgaaatattatgatctgaacttagcacacatgaagcaacattt
ctttgctacacagaggtgtcttggaaagatttcattcccaattcatttttcatagatctataatcaggcaatttctgcaa
gcaatgtatgaccccacctgagcaaccacaaataggctctccatgaaactgcaaaggaactgatgtgtggcatccatgct
ggttttgtctgtctataatatgaattcaagtatctgttcatatttccaattgtctcctgctagcaatatgtgccacaaca
tgacagtcttgtgacatcttaaggaaaagaagagttcctgttaaatgaatagctttagcttttacaggggattatgatta
aaagtgatttagtacatcttacatgatatctcatttctacgtgaaaagaagttatagaatcttcatagagttccatgaga
aaaatatacttgctatttat
```

FIGURE 14(continuing)

HNL4Y (SEQ ID NO:8)

MLRPQGLLWLPLLFTSVCVMLNSNVLLWITALAIKFTLIDSQAQYPVVNTNYGKIQGLRTPLPSEILGPVEQYLGVPYAS
PPTGERRFQPPESPSSWTGIRNATQFSAVCPQHLDERFLLHDMLPIWFTTSLDTLMTYVQDQNEDCLYLNIYVPMEDGTN
IKRNADDITSNDHGEDKDIHEQNSKKPVMVYIHGGSYMEGTGNMIDGSILASYGNVIVITINYRLGILAQNTLAHGNCKH
RCQLHLQAPRDCKSAYPFRNEDEIRDGVLLCHPG

FIGURE 15

Protéine HNL4X mutée (SEQ ID NO:9)

MSRPQGLLWLPLLFTPVCVMLNSNVLLWLTALAIKFTLIDSQAQYPVVNTNYGKIRGLRTPLPNEILGPVEQYLGVPYAS
PPTGERRFQPPEPPSSWTGIRNTTQFAAVCPQHLDERSLLHDMLPIWFTANLDTLMTYVQDQNEDCLYLNIYVPTEDDIH
DQNSKKPVMVYIHGGSYMEGTGNMIDGSILASYGNVIVITINYRLGILGFLSTGDQAAKGNYGLLDQIQALRWIEENVGA
FGGDPKRVTIFGSGAGASCVSLLTLSHYSEGLFQKAIIQSGTALSSWAVNYQPAKYTRILADKVGCNMLDTTDMVECLRN
KNYKELIQQTITPATYHIAFGPVIDGDVIPDDPQILMEQGEFLNYDIMLGVNQGEGLKFVDGIVDNEDGVTPND

FIGURE 16

Famille 1
HNL3 R451C
*Neuroligins*                                                              451

| | | | |
|---|---|---|---|
| Variant | PEGKDTLRETIKFMYTDWADRD-NPETR | C | KTLVALFTDHQWVEP |
| Human | PEGKDTLRETIKFMYTDWADRD-NPETR | R | KTLVALFTDHQWVEP |
| Bos taurus | PEGKDTLRETIKFMYTDWADRD-NPETR | R | KTLVALFTDHQWVEP |
| Rat | PEGKDTLRETIKFMYTDWADRD-NPETR | R | KTLVALFTDHQWVEP |
| Mouse | PEGKDTLRETIKFMYTDWADRD-NPETR | R | KTLVALFTDHQWVEP |
| Droso neuroligin | HLNE--IFAVLKNEYTDWEKAIRNPLSS | R | DATLQFLSDGHTASP |
| Droso gliotactin | TLNPNGVYEAIKYIYTFWPDPN-NNTII | R | DQYINMLSDLYYRAP |

*Acetylcholine esterase*

| | | | |
|---|---|---|---|
| Human | PQVSDLAAEAVVLHYTDWLHPE-DPARL | R | EALSDVVGDHNVVCP |
| Bovin | PQASDLAAEAVVLHYTDWLHPE-DPARL | R | EALSDVVGDHNVVCP |
| Rabbit | PQASDLAAEAVVLHYTDWLHPE-DPARL | R | DALSDVVGDHNVVCP |
| Cat | PQASDLAAEAVVLHYTDWLNPE-DPARL | R | EAMSDVVGDHNVVCP |
| Mouse | PQASDLAAEAVVLHYTDWLHPE-DPTHL | R | DAMSAVVGDHNVVCP |
| Rat | PQASDLAAEAVVLHYTDWLHPE-DPAHL | R | DAMSAVVGDHNVVCP |
| Chicken | PQATELAAEAVVLHYTDWLDAD-NPVKN | R | EALDDIVGDHNVVCP |
| Snake | PHANDIATDAVVLQYTDWQDQ-NREKN | R | EALDDIVGDHNVICP |
| Electrophorus | PHANEIGLEAVILQYTDWMDED-NPIKN | R | EAMDDIVGDHNVVCP |
| Torpedo | PHANDLGLDAVTLQYTDWMDDN-NGIKN | R | DGLDDIVGDHNVICP |
| Zebra | PHANDIGLEAVILQYTDWMDEN-NGQKN | R | DAMDDIVGDQNVICP |
| Hagfish | PQGNEVSVDAIVLQYTDWLAQN-DALKN | R | DAIEDIVGDYNVICP |
| Amphoxius | PRLNDITVERTAFEYTDWLHMD-QDTMY | R | DALDSVFGDPFFVCP |
| Aphis gossypii | PNADAAVKSAIEFEYTDWFNPN-DPEKN | R | NALDKMVGDYQFTCN |

*Butyrylcholine esterase*

| | | | |
|---|---|---|---|
| Human | PGVSEFGKESILFHYTDWVDD-QRPENY | R | EALGDVVGDYNFICP |
| Mouse | PGVSRLGKEAVLFYYVDWLGE-QSPEVY | R | DALDDVIGDYNIICP |
| Horse | PRVSEFGRESILFHYMDWLDD-QRAENY | R | EALDDVVGDYNIICP |
| Rabbit | PGVSEFGKESILFHYTDWVDE-QRPENY | R | EALDDVVGDYNFICP |

Family 2
HNL3 N796S                                              796

| | | | |
|---|---|---|---|
| Variant | PDDIPLMTPNTITMIP | S | SLVGLQTLHPYNTFAAGFNSTG |
| Human | PDDIPLMTPNTITMIP | N | SLVGLQTLHPYNTFAAGFNSTG |
| Bos taurus | PNTITIIP | N | SLVGLQTLHPYNTFAAGFNSTG |
| Rat | PDDIPLMTPNTITMIP | N | SLVGLQTLHPYNTFAAGFNSTG |
| Mouse | PDDIPLMTPNTITMIP | N | SLVGLQTLHPYNTFAAGFNSTG |
| Zebra fish | PDDIPLMTPNTITMIP | N | SMPGLTSLHPFNSYSSGQNNT |

FIGURE 18

```
gcacgaggctgcgtgcggagcctgggcctcctcggccgccgcgcccgccccgcccccgtgaccccgtgaccccggggt
cggaggccgcaggcaggcccccgcccccacacaggaagtgggtggagaccaggtcgccggcggccatgatggatccggag
cggtgacgtcgcctggccccgccctaactcagcctacgctgtgattgacgggtggcctgccccaccccccccacgccgcg
gtgacgtcacaggaagtggcagggctgcggcaggaagtgttgcgctgagccagaagcggtcggaacggacaggaagtgac
ctcaccctaggccgtggttgccgtgacgaaacaggaagtgacctcaggagggaccggaagtgaccgggtcacccacgaa
cccgcccaccgcgacaggaagtgaccgtgcagtcgcagggagcagccaggggcgaccggaagtgacgtcgccgtgaca
ggaagtgacgtcgccttgacaggaagtggctgcgtgaccggaagtgacgtcgccgtgaccggaagtggctgcgtgaccgg
aagtgacgtcgccgtgaccagatgtgacgtcgccgtgacaggaagtgacatcaccgtgacaggaagtctctgccggccgc
cATGCCCGCCCCCGTCCCCGCCCTTTTGTGCCTCGCCCTCGCCCTGGCATCCGCCCAGCCGTCCCCGCCGCCGCCGC
CGTTCCCCGTGGTGGCCACGAACTACGGGAAGCTGCGCGGGGTGCGGGCGGCGCTGCCGGGCGACGTGCTGGGCCCCGTG
ACGCAGTTCCTGGGCGTGCCCTACGCGGCCCCGCCCACCGGCGAGCGCCGCTTCCAGCCGCCCGAGCCGCCGTCCTCCTG
GGCCGGCGTCCGCGACGCCACGCGGTTCGCGCCCGTCTGCCCGCAGCACCTGGACGAGCGCGCGCTGCTGCGCGACTGCC
TCCCCGCCTGGTTCGCCGCCAACCTCGACGCCATCGCCGCCGACGTCCAGGACCAGAGCGAGGACTGCCTGTACCTCAAC
CTCTACGTGCCCGGCGGAGCCAACGGTAAGAAAATGGCCGACGATGTCACCGGCAACGACCACGGTGACGACCAAGACTC
CCGTGACCCCGGCGTGGGCGGCGCGGCGGCGGCGGCGGCGAGGAAGCCGGTCATGGTTTACATCCACGGCGGCTCCTACA
TGGAGGGCACCGCGAACATCGTGGACGGCAGCGTCCTCGCCAGCTACGGCGACGTCATCGTCGTCCACCGTCAACTACCGG
CTCGGCGTGCTCGGCTTCCAGAGCACGGGCGACCAGGCCGCCAAGGGCAACTACGGGCTGCTGGACCAGATCCAGGCGCT
GCGCTGGGTGGAGGAGAACGCGGGCGCCTTCGGCGGGGACCCCGACCGCGTCACCGTCTTCGGCTCCGGCGCCGGCGCCT
CCTGCGTCAGCCTCCTCACGCTGTCGCACTACTCGGAGGGCCTGTTCCAGAAGGCCATCATCCAGAGCGGGACGGCGCTG
TCGAGCTGGGCGGTGAACTACCAGCCGGCCCGGTACGCGCGGGCGCTGGGCGAGCGCGTGGGCTGCGCGACCCCCGACCC
GGGGTCGCCGCCGGGGTCGCCGCCGGGTTGGGACTCGGCGTCGCTGGTGTCCTGCCTGCGGGGCAAGGCGGCGGGCGAGC
TGGCGCGGGCCCGCGTGACGCCCGCGACCTACCACGTGGCGTTCGGGCCGACGGTGGACGGCGACGTCATCCCCGACGAC
CCCCAGATCCTGATGGAGCAGGGCGAGTTCCTCAACTACGACATCATGCTCGGCGTCAACCAGGGCGAGGGCGCGCGCTT
CGTCGACGGCCTCGGCGGCGGCCACGACGGCGGCTACGGCGGATACGGCGGCGGGTACGGCGGCGGCGTCGAGGACGACG
AGGTCCAAGATGGCGGCCCGGACGGCGCCGCGGGCGGCGTGTCGGCGGGCGAGTTCGACCTGGCGGTGTCCGGCTTCATC
AACGACCTCTACGGCCGCCCCGAGGGCCGCGGCGACGCCCTGCGCGAGACGGTGAAGTTCATGTACACCGACTGGGCCGA
CCGCGACAGCCCCGAGGCGCGGCGCAAGACGCTCGTGGCGCTCTTCACCGACCACCAGTGGGTGGCGCCCGCCGTGGCCA
CCGCCGACCTCCACGCCCGCTACGGCTCCCCCACCTACTTCTACGCCTTCTACCACCGGTGCCACGCGGCGTCCCGCGGT
GATGACGTCGTCGTCGATGGCGTCGGGCTCGGGGATGACGTCGTCGTCCGGCTCGGGGATGACGTCGTCGGGGTAGN
NTCGGCGTCCGCGGTGCTGATCGAGACGCGGCGCGACTACTCGACGGAGCTGAGCGTGACGATCGCGGTGGGGCCTCGC
TGCTCTTCCTCAACGTCCTCGCCTTCGCCGCGCTCTACTACAAGAAGGACAAGCGCCGGCACGAGACGCACCGCAGGCCG
CCCCCGCCACGCCCCCGCAGGCCCCGCCCTCCGCCGCCGCCGCCGACCGGAACCCGCGACCCGACCCCGGGCCGGCCGG
CCGGCGTGGCGGGGAGTGCGGTGCAGTGGTCACCGCGATGCGCGGCGAGGCGTCGGCGGCGCCTGGGCCACGACGGCG
TCGGCGGGGTCGGGGTCGGCGGGGTCATCGGCGGGGTCGCCGGCCTGCGCCTGGCCTGCCCGCCCGACTACGCGCTGACC
CTGCGGCGCTCGCCCGACGACGTCCCCCGGGCCGGGGCCGGGCCGGGCGCCATGACGCTCATCCCCGGGCGCTGGGTGG
AGGCGGCGGCGGCGCCGTGCACGGGTTCAACACCCTTTGGGAGCGGGGTCGGCGTCGCCGGGGTCGCCGGGGTCGCGACCT
CGCAGGCCGGGCCGGGGCTGCCCCACGGACACTCGACCACCCGGGTATAGcgtggcgagcgcgggagcttggcggggcg
gagcgtggactcctgtgaagccccgcccaccggcccaaaagcccgccccgcccggcgaggccccgcccacagccgcgg
acatgcaggggccttggctacggcaggcgatgacgtcaccgccctgaccacgcccccttccccgtcgcgggacatgaggt
cgactgaggggcggagtcagggcagtgggtggggtccggatggtaacggggaaccggatagaaccggatgggaccgcatt
gatccggagggaaccggatggaactggattgagccgggtcagcacgggttggactggattgaaccggattaatccggatg
gagccggtgatgccaggcctgagctgagcagcctggtgtgggcggaaccggatgagaccggataaaaccggcctgaaccc
gcgcgcgcgaccagcaccgagctggtcgatgtggaccaaacctgaatggaccggattggaccgggctacgccggctggat
ccggatccgactgggcgggaccgagaccggatgggaccggatggaaccggttcagaccgggctcggctggatcagactgg
acggaggggttggcgcggaccaaggcaagggcgccgggtcggacctgacgcagccggacaagaccggttcggaccaggc
ggaaccggattgggctgtgtccctgtgggcagaaccggatttactggattttaccggatgggacaggaatggacgagag
cagcgtgaactgcatgaaaccgctttagaccggaatgaaccggaatgaaccggatcaagtgggagaccggatggcatcca
gggcactggacagatccggactgaactggaacggaccggatcgatccggatgggaccggatggagccgcgtcgcctcgca
cggccccgggcacgcggacggcggacattttacattttatcgtcaatgacgctcacggccgcgagtgaggtcatcgggga
gcggtgggggatggaggggggcggagtcttatttttttattagaattcggatcgcgtcgtttcctccctggcgcccgacag
agccgggtgcgcggttgccgccacgattctatctttcctcattttttaattttatttctatttattttttggttatattttt
aatttttattatactttttatttattgtgtatctttattttaaattattttttagcgccgcgtcggcgcaccgacgttt
ccggattttttgttatatgttaaatgacccagatttgaaacttaattttgttacagtgtcacgtttacattgatattagg
ggctaaaataatttgtatgtccacgttgaaaagtgagaccttggaaattcgggggaaacttctagtttgcagagatctgt
gagaagaggtgggatctcaagggttcaatgttgggcaaattctgtgtaaacggatttagatgtatggtagattaacgttc
gcctttattggagagttaatatagag
```

FIGURE 19A

MPAPVPALLCLALALASAQPSPPPPPPFPVVATNYGKLRGVRAALPGDVLGPVTQFLGVPYAAPPTGERRFQPPEPPSSW
AGVRDATRFAPVCPQHLDERALLRDCLPAWFAANLDAIAADVQDQSEDCLYLNLYVPGGANGKKMADDVTGNDHGDDQDS
RDPGVGGAAAAAARKPVMVYIHGGSYMEGTANIVDGSVLASYGDVIVVTVNYRLGVLGFQSTGDQAAKGNYGLLDQIQAL
RWVEENAGAFGGDPDRVTVFGSGAGASCVSLLTLSHYSEGLFQKAIIQSGTALSSWAVNYQPARYARALGERVGCATPDP
GSPPGSPPGWDSASLVSCLRGKAAGELARARVTPATYHVAFGPTVDGDVIPDDPQILMEQGEFLNYDIMLGVNQGEGARF
VDGLGGGHDGGYGGYGGGYGGGVEDDEVQDGGPDGAAGGVSAGEFDLAVSGFINDLYGRPEGRGDALRETVKFMYTDWAD
RDSPEARRKTLVALFTDHQWVAPAVATADLHARYGSPTYFYAFYHRCHAASRGDDVVVDGVGLGDDVVVRLGDDVVVGVX
SASAVLIETRRDYSTELSVTIAVGASLLFLNVLAFAALYYKKDKRRHETHRRPPPPRPPQAPPSAAAADRNPRPDPGPAG
RRGGECGAVVTAMAAEASAGGLGHDGVGGVGVGGVIGGVAGLRLACPPDYALTLRRSPDDVPRAGAGPGAMTLIPGALGG
GGGGAVHGFNTFGSGVGVAGVAGVATSQAGPGLPHGHSTTRV

FIGURE 19B

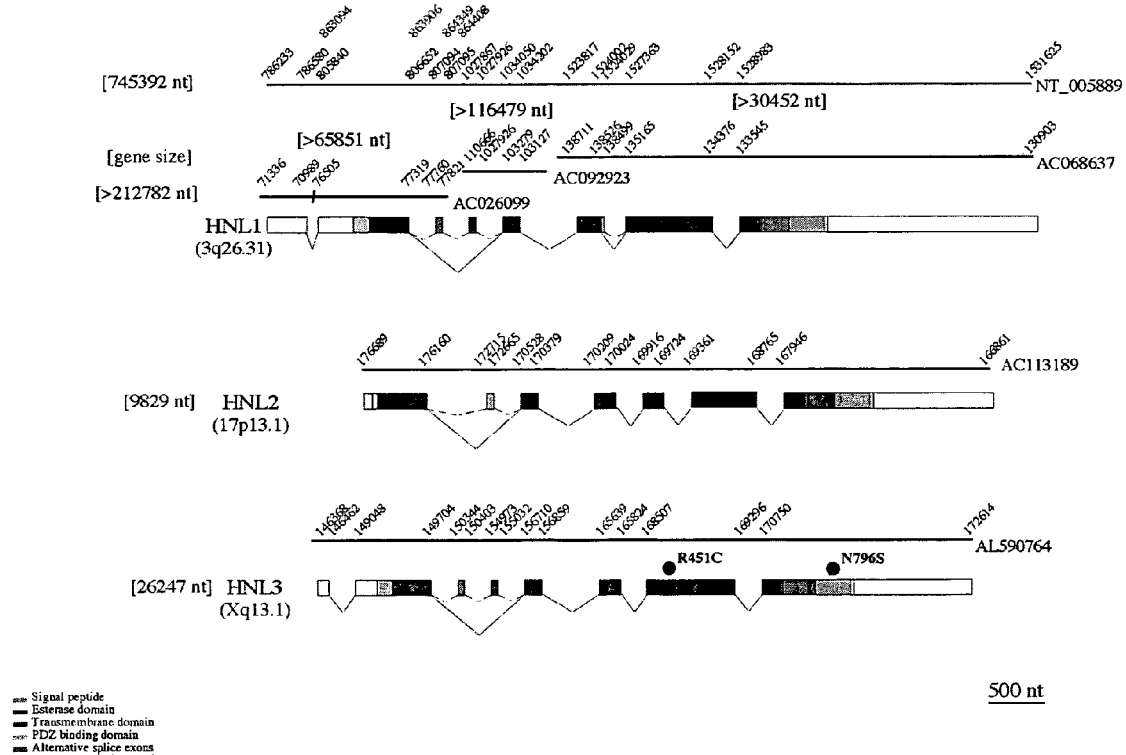

FIGURE 20

SEQ ID NO: 10

PEGKDTLRETIKFMYTDWADRDNPETR| C |KTLVALFTDHQWVEP

FIGURE 22

SEQ ID NO: 11

PDDIPLMTPNTITMIP| S |SLVGLQTLHPYNTFAAGFNSTG

FIGURE 23

SEQ ID NO: 12 ctgatctcggggattcgggtgcggagcccttggcctggaggcgatatgggtggtccgtggcccggttcagtcgcttgcag
cagcccggggaacaggcctgtctggccctgagggagtcccctttctgaagctgtggtgcttggacgacctgctctctaca
ttgctgggcacctgtaggtgtccctcgagagctcagttttgaggttcaagtcagtgtggccatgaaggggctgcctattg
ggctgatgctgtgaccctggagtctgcctctcctgccagtcccctgcccggaacATGTGGCTGCGGCTTGGCCCGCCCT
CGCTGTCCCTGAGCCCCAAGCCCACGGTTGGCAGGAGCCTGTGCCTCACCCTGTGGTTCCTCAGTTTGGCGCTGAGGGCC
AGTACCCAGGCCCCAGCACCCACAGTCAACACTCACTTTGGGAAGCTAAGGGGTGCCCGAGTACCACTGCCCAGTGAGAT
CCTGGGGCCTGTGGACCAATACCTGGGGGTGCCCTACGCAGCTCCCCCGATCGGCGAGAAACGTTTCCTGCCCCCTGAAC
CACCCCCATCCTGGTCGGGCATCCGGAACGCCACACACTTTCCCCCAGTGTGCCCCCAGAACATCCACACAGCTGTGCCC
GAAGTCATGCTGCCGGTCTGGTTCACTGCCAACTTGGATATCGTCGCTACTTACATCCAGGAGCCCAACGAAGACTGTCT
CTACCTGAACGTCTATGTGCCGACGGAGGATGGATCCGGCGTCAAGAAACAGGGCGAGGACTTAGCGGATAATGACGGGG
ATGAAGATGAAGACATCCGGGACAGTGGTGCTAAACCCGTCATGGTCTACATCCACGGAGGCTCTTACATGGAAGGGACA
GGCAACATGATTGATGGCAGCATCCCCGCCAGTTATGCAATGTCATAGTCATCACCCTCAACTATCGGGTTGGAGTGCT
AGGTTTCCTGAGTACTGGAGATCAGGCTGCCAAGGGCAACTATGGGCTCCTTGACCAGATCCAGGCCCTCCGCTGGGTGA
GCGAGAATATTGCCTTCTTCGGGGGAGACCCCCGCCGGATCACTGTCTTTGGCTCGGGCATTGGTGCATCCTGCGTCAGC
CTCCTCACGTTGTCACATCACTCAGAGGGACTTTTCCAGAGAGCCATCATCCAAAGTGGCTCTGCTCTGTCCAGCTGGGC
TGTGAACTACCAACCAGTGAAGTACACCAGCCTGCTGGCAGACAAAGTGGGCTGTAATGTGCTGGACACCGTGGATATGG
TGGACTGTCTTCGGCAAAAGAGTGCCAAGGAGCTGGTAGAGCAGGACATCCAGCCAGCCCGCTACCACGTGGCCTTTGGC
CCTGTGATTGATGGTGATGTCATTCCTGATGACCCTGAGATCCTCATGGAGCAGGGCGAGTTCCTCAACTATGACATCAT
GCTAGGTGTCAACCAGGGCGAGGGTCTCAAGTTTGTGGAAGGGGTGGTGGACCCTGAGGATGGTGTCTCTGGCACTGACT
TTGACTATTCCGTCTCCAATTTTGTGGACAATCTGTATGGCTATCCTGAGGGTAAGGACACCCTGCGAGAGACCATCAAG
TTCATGTATACAGACTGGGCAGACCGTGACAACCCTGAGACCCGCCGTAAAACACTGGTGGCACTCTTCACTGACCACCA
GTGGGTGGAGCCCTCAGTGGTGACAGCCGATCTGCATGCCCGCTACGGCTCGCCTACCTACTTCTACGCCTTCTATCATC
ACTGCCAGAGCCTCATGAAGCCTGCTTGGTCAGATGCAGCTCATGGGGATGAAGTACCCTATGTTTTGGGGTTCCTATG
GTAGGCCCCACTGACCTTTTCCCCTGCAACTTCTCCAAGAATGATGTTATGCTCAGTGCTGTCGTCATGACCTATTGGAC
CAACTTTGCCAAGACTGGGGATCCCAACAAGCCGGTCCCCCAGGACACCAAGTTCATTCACACCAAGGCCAACCGCTTTG
AGGAAGTGGCCTGGTCCAAATACAATCCCCGAGACCAGCTCTACCTTCACATCGGGCTGAAACCAAGGGTCCGAGATCAT
TACCGGGCACTAAGGTGGCCTTTTGGAAACATCTGGTGCCCCACCTATACAACCTGCATGACATGTTCCACTATACGTC
CACCACCACCAAAGTGCCGCCTCCGGATACCACCCACAGCTCCCACATCACCCGCAGGCCCAATGGCAAGACCTGGAGCA
CCAAGCGGCCAGCCATCTCACCTGCCTACAGCAACGAGAATGCCCAGGGGTCCTGGAACGGGGACCAGGATGCAGGGCCA
CTCCTGGTGGAGAACCCTCGTGACTACTCCACTGAATTAAGTGTCACCATCGCCGTGGGGGCCTCCCTCCTGTTCCTTAA
CGTTCTGGCCTTCGCTGCCCTCTACTACCGTAAGGACAAACGGCGCCAGGAGCCCCTGCGGCAGCCTAGCCCTCAGCGGG
GAGCCGGGGCCCCGGAGTTGGGAGCTGCTCCAGAGGAGGAGCTGGCAGCATTACAACTGGGCCCCACCCACCACGAGTGT
GAGGCCGGTCCCCCCCATGACACGCTGCGCCTCACTGCATTGCCCGACTACACCCTGACCCTGCGGCGCTCCCCGGATGA
CATCCCCACTCATGACCCCCAACACCATCACTATGATCCCCAACTCCCTGGTAGGGCTGCAGACATTGCACCCCTATAACA
CCTTTGCCGCAGGGTTCAACAGTACCGGGCTGCCCCACTCACACTCCACTACCCGGGTATAGctccaactcagagcacag
ccaatctccaggctccctccctcccagatccaggaacacatgcacacacacacacacacacgcagacacacacacaca
cacacatatatgtatacgcacgcacccacaccctacagcagatccacctgcacaaacatagacagatgtggacatgcacc
cgcatgtacaaaaacacaaatacggaagtaaacctgaacaaacccctttaaatggggacgcagatgagtcctcggtaaacc
gaggacccatgaaacagcagctgaagccagctccctgaatctgaccacagacactcctgggggggcctgaaagcaacagct
ggacacccccttggtgctcgccttcggcctctcttggaactgcaccaccgaccaactccagacttgggagctttaaagag
caggatagctcttcctccccaggacttggtcttttttctgggtcttgttttgttgattttttctttttttaatttttggaaca
aatgcttttccaacccatgagtgctaagagcctctggaagggagggcttcaggcccgaaggtctctctggctctaggacc
cccagtgctcacacaatcagaccaaggaacaagacccccaggaaggaaacagatttaagcaagaccatgggtggaagga
gaaaggggctagcactggatggagctggagggtcgtaggggagagatctccaactctctctgtgtccgtgtggagggctg
cagagcctgcagggtgacctgcttccccaaaggccaacagcattggcctggccagaccaggtgaccttagatttggtgaa
caacgtactatggaagccacatcactattgggccccaggtctgatctgggttttgcctctgcccttggggaaatgctat
cagaaattcgccccattttctttacagtcttttgtgtctgtcattctctttcaaaaaggcggtgtttttgttgttgtt
ggttttttttttttttaaagaaaagttcttaaaacactaacgaaaaaaaaaa

FIGURE 24

SEQ ID NO: 13

```
ctgatctcggggattcgggtgcggagcccttggcctggaggcgatatgggtggtccgtggcccggttcagtcgcttgcag
cagcccggggaacaggcctgtctggccctgagggagtcccctttctgaagctgtggtgcttggacgacctgctctctaca
ttgctgggcacctgtaggtgtccctcgagagctcagttttgaggttcaagtcagtgtggccatgaagggctgcctattg
ggctgatgctgtgaccctggagtctgcctctcctgccagtcccctgcccggaacATGTGGCTGCGGCTTGGCCCGCCCT
CGCTGTCCCTGAGCCCCAAGCCCACGGTTGGCAGGAGCCTGTGCCTCACCCTGTGGTTCCTCAGTTTGGCGCTGAGGGCC
AGTACCCAGGCCCCAGCACCCACAGTCAACACTCACTTTGGGAAGCTAAGGGGTGCCCGAGTACCACTGCCCAGTGAGAT
CCTGGGGCCTGTGGACCAATACCTGGGGGTGCCCTACGCAGCTCCCCGATCGGCGAGAAACGTTTCCTGCCCCCTGAAC
CACCCCCATCCTGGTCGGGCATCCGGAACGCCACACACTTTCCCCAGTGTGCCCCCAGAACATCCACACAGCTGTGCCC
GAAGTCATGCTGCCGGTCTGGTTCACTGCCAACTTGGATATCGTCGCTACTTACATCCAGGAGCCCAACGAAGACTGTCT
CTACCTGAACGTCTATGTGCCGACGGAGGATGGATCCGGCGCTAAGAAACAGGGCGAGGACTTAGCGGATAATGACGGGG
ATGAAGATGAAGACATCCGGGACAGTGGTGCTAAACCCGTCATGGTCTACATCCACGGAGGCTCTTACATGGAAGGGACA
GGCAACATGATTGGCAGCATCCCCGCCAGTTATGGCAATGTCATAGTCATCACCCTCAACTATCGGGTTGGAGTGCT
AGGTTTCCTGAGTACTGGAGATCAGGCTGCCAAGGGCAACTATGGGCTCCTTGACCAGATCCAGGCCCTCCGCTGGGTGA
GCGAGAATATTGCCTTCTTCGGGGGAGACCCCCGCCGGATCACTGTCTTTGGCTCGGGCATTGGTGCATCCTGCGTCAGC
CTCCTCACGTTGTCACATCACTCAGAGGGACTTTTCCAGAGAGCCATCATCCAAAGTGGCTCTGCTCTGTCCAGCTGGGC
TGTGAACTACCAACCAGTGAAGTACACCAGCCTGCTGGCAGACAAAGTGGGCTGTAATGTGCTGGACACCGTGGATATGG
TGGACTGTCTTCGGCAAAAGAGTGCCAAGGAGCTGGTAGAGCAGGACATCCAGCCAGCCCGCTACCACGTGGCCTTTGGC
CCTGTGATTGATGGTGATGTCATTCCTGATGACCCTGAGATCCTCATGGAGCAGGGCGAGTTCCTCAACTATGACATCAT
GCTAGGTGTCAACCAGGGCGAGGGTCTCAAGTTTGTGGAAGGGGTGGTGGACCCTGAGGATGGTGTCTCTGGCACTGACT
TTGACTATTCCGTCTCCAATTTTGTGGACAATCTGTATGGCTATCCTGAGGGTAAGGACACCCTGCGAGAGACCATCAAG
TTCATGTATACAGACTGGGCAGACCGTGACAACCCTGAGACCCGCTGTAAAACACTGGTGGCACTCTTCACTGACCACCA
GTGGGTGGAGCCCTCAGTGGTGACAGCCGATCTGCATGCCCGCTACGGCTCGCCTACCTACTTCTACGCCTTCTATCATC
ACTGCCAGAGCCTCATGAAGCCTGCTTGGTCAGATGCAGCTCATGGGGATGAAGTACCCTATGTTTTTGGGGTTCCTATG
GTAGGCCCCACTGACCTTTTCCCCTGCAACTTCTCCAAGAATGATGTTATGCTCAGTGCTGTCGTCATGACCTATTGGAC
CAACTTTGCCAAGACTGGGGATCCCAACAAGCCGGTCCCCCAGGACACCAAGTTCATTCACACCAAGGCCAACCGCTTTG
AGGAAGTGGCCTGGTCCAAATACAATCCCCGAGACCAGCTCTACCTTCACATCGGGCTGAAACCAAGGGTCCGAGATCAT
TACCGGGCCACTAAGGTGGCCTTTTGGAAACATCTGGTGCCCCACCTATACAACCTGCATGACATGTTCCACTATACGTC
CACCACCACCAAAGTGCCGCCTCCGGATACCACCCACAGCTCCCACATCACCCGCAGGCCCAATGGCAAGACCTGGAGCA
CCAAGCGGCCAGCCATCTCACCTGCCTACAGCAACGAGAATGCCCAGGGGTCCTGGAACGGGGACCAGGATGCAGGGCCA
CTCCTGGTGGAGAACCCTCGTGACTACTCCACTGAATTAAGTGTCACCATCGCCGTGGGGGCCTCCCTCCTGTTCCTTAA
CGTTCTGGCCTTCGCTGCCCTCTACTACCGTAAGGACAAACGGCGCCAGGAGCCCCTGCGGCAGCCTAGCCCTCAGCGGG
GAGCCGGGGCCCCGGAGTTGGGAGCTGCTCCAGAGGAGGAGCTGGCAGCATTACAACTGGGCCCCACCCACCACGAGTGT
GAGGCCGGTCCCCCCCATGACACGCTGCGCCTCACTGCATTGCCCGACTACACCCTGACCCTGCGGCGCGCTCCCCGGATGA
CATCCCACTCATGACCCCCAACACCATCACTATGATCCCCAACTCCCTGGTAGGGCTGCAGACATTGCACCCCTATAACA
CCTTTGCCGCAGGGTTCAACAGTACCGGGCTGCCCCACTCACACTCCACTACCCGGGTATAGctccaactcagagcacag
ccaatctccaggctccctccctcccagatccaggaacacatgcacacacacacacacacacacgcagacacacacacaca
cacacatatatgtatacgcacgcacccacaccctacagcagatccacctgcacaaacatagacagatgtggacatgcacc
cgcatgtacaaaaacacaaatacggaagtaaacctgaacaaacccttttaaatggggacgcagatgagtcctcggtaaacc
gaggacccatgaaacagcagctgaagccagctccctgaatctgaccacagacactcctgggggcctgaaagcaacagct
ggacacccccttggtgctcgccttcggcctctcttggaactgcaccaccgaccaactccagacttgggagctttaaagag
caggatagctcttcctccccaggacttggtctttttttctgggtcttgttttgttgattttttcttttttaattttggaaca
aatgcttttccaacccatgagtgctaagagcctctggaagggagggcttcaggcccgaaggtctctctggctctaggacc
cccagtgctcacacaatcagaccaaggaacaagaccccaggaagggaaacagatttaagcaagaccatggggtggaagga
gaaagggctagcactggatggagctggagggtcgtaggggagagatctccaactctctctgtgtccgtgtggagggctg
cagagcctgcagggtgacctgcttccccaaaggccaacagcattggcctggccagaccaggtgaccttagatttggtgaa
caacgtactatggaagccacatcactattgggcccccaggtctgatctgggttttgcctctgcccttggggaaatgctat
cagaaattcgccccatttttctttacagtcttttgtgtctgtcatttctctttcaaaaaggcggtgttttttgttgttgtt
ggttttttttttttttaaagaaaagttcttaaaacactaacgaaaaaaaaa
```

FIGURE 25

SEQ ID NO: 14

MWLRLGPPSLSLSPKPTVGRSLCLTLWFLSLALRASTQAPAPTVNTHFGKLRGARVPLPSEILGPVDQYLGVPYAAPPIG
EKRFLPPEPPPSWSGIRNATHFPPVCPQNIHTAVPEVMLPVWFTANLDIVATYIQEPNEDCLYLNVYVPTEDGSGAKKQG
EDLADNDGDEDEDIRDSGAKPVMVYIHGGSYMEGTGNMIDGSIPASYGNVIVITLNYRVGVLGFLSTGDQAAKGNYGLLD
QIQALRWVSENIAFFGGDPRRITVFGSGIGASCVSLLTLSHHSEGLFQRAIIQSGSALSSWAVNYQPVKYTSLLADKVGC
NVLDTVDMVDCLRQKSAKELVEQDIQPARYHVAFGPVIDGDVIPDDPEILMEQGEFLNYDIMLGVNQGEGLKFVEGVVDP
EDGVSGTDFDYSVSNFVDNLYGYPEGKDTLRETIKFMYTDWADRDNPETRRKTLVALFTDHQWVEPSVVTADLHARYGSP
TYFYAFYHHCQSLMKPAWSDAAHGDEVPYVFGVPMVGPTDLFPCNFSKNDVMLSAVVMTYWTNFAKTGDPNKPVPQDTKF
IHTKANRFEEVAWSKYNPRDQLYLHIGLKPRVRDHYRATKVAFWKHLVPHLYNLHDMFHYTSTTTKVPPPDTTHSSHITR
RPNGKTWSTKRPAISPAYSNENAQGSWNGDQDAGPLLVENPRDYSTELSVTIAVGASLLFLNVLAFAALYYRKDKRRQEP
LRQPSPQRGAGAPELGAAPEEELAALQLGPTHHECEAGPPHDTLRLTALPDYTLTLRRSPDDIPLMTPNTITMIPNSLVG
LQTLHPYNTFAAGFNSTGLPHSHSTTRV

FIGURE 26

SEQ ID NO: 15

MWLRLGPPSLSLSPKPTVGRSLCLTLWFLSLALRASTQAPAPTVNTHFGKLRGARVPLPSEILGPVDQYLGVPYAAPPIG
EKRFLPPEPPPSWSGIRNATHFPPVCPQNIHTAVPEVMLPVWFTANLDIVATYIQEPNEDCLYLNVYVPTEDGSGAKKQG
EDLADNDGDEDEDIRDSGAKPVMVYIHGGSYMEGTGNMIDGSIPASYGNVIVITLNYRVGVLGFLSTGDQAAKGNYGLLD
QIQALRWVSENIAFFGGDPRRITVFGSGIGASCVSLLTLSHHSEGLFQRAIIQSGSALSSWAVNYQPVKYTSLLADKVGC
NVLDTVDMVDCLRQKSAKELVEQDIQPARYHVAFGPVIDGDVIPDDPEILMEQGEFLNYDIMLGVNQGEGLKFVEGVVDP
EDGVSGTDFDYSVSNFVDNLYGYPEGKDTLRETIKFMYTDWADRDNPETRCKTLVALFTDHQWVEPSVVTADLHARYGSP
TYFYAFYHHCQSLMKPAWSDAAHGDEVPYVFGVPMVGPTDLFPCNFSKNDVMLSAVVMTYWTNFAKTGDPNKPVPQDTKF
IHTKANRFEEVAWSKYNPRDQLYLHIGLKPRVRDHYRATKVAFWKHLVPHLYNLHDMFHYTSTTTKVPPPDTTHSSHITR
RPNGKTWSTKRPAISPAYSNENAQGSWNGDQDAGPLLVENPRDYSTELSVTIAVGASLLFLNVLAFAALYYRKDKRRQEP
LRQPSPQRGAGAPELGAAPEEELAALQLGPTHHECEAGPPHDTLRLTALPDYTLTLRRSPDDIPLMTPNTITMIPNSLVG
LQTLHPYNTFAAGFNSTGLPHSHSTTRV

POLYNUCLEOTIDE AND PROTEIN INVOLVED IN SYNAPTOGENESIS VARIANTS THEREOF AND THEIR THERAPEUTIC AND DIAGNOSTIC USES

CONTEXT OF THE INVENTION a) Field of the Invention

The present invention relates to the identification of a human gene encoding a protein involved in synapto-genesis and of its murine orthologs, the mutation of which is associated in humans with the development of neurological diseases and/or with a predisposition to the development of mental disorders or psychiatric diseases such as autism and Asperger syndrome.

The invention also relates to the diagnostic and therapeutic uses associated with identifying the gene and its mutations.

The invention also relates to the diagnostic and therapeutic uses associated with identifying the involvement of a defect in a protein of the neuroligin family in the development of mental disorders or psychiatric diseases such as autism and Asperger syndrome.

b) Brief Description of the Prior Art

Autism is a disease which affects around one child in 1000 and mainly boys (from 4 to 23 boys to one girl according to the selected clinical criteria). The clinical symptoms of autism are described in the DSM-IV-TR™ manual (Diagnostic and statistical manual of mental disorders, 2000, pages 70-75).

The molecular bases of autism are currently unknown. Studies have already suggested the existence of a genetic component in autism. Based on linkage analysis results, Philippe et al. (Human Molecular Genetics, 1999, 8:805-812) describes 11 chromosomal regions which may be involved in the development of autism, among which is a region of chromosome Xp. In addition, Thomas et al. (Hum. Genet., 1999, 104:43-48) describes deletions of the short arm of the X chromosome in patients suffering from autism, and Milunsky et al. (Clin. Genet., 1999, 55:455-460) describes deletions in Xp22 in patients suffering from schizophrenia and suggests, more precisely, the involvement of a deletion in Xp22.3 in the development of this psychiatric disease. However, neither the gene involved in the disease nor the nature of the mutation are mentioned.

The neuroligins (HNLs) are cell adhesion proteins which can trigger, by themselves, synaptogenesis, i.e. the formation of synapses (Scheiffele et al., Cell, 2000, 101:657-669). The neuroligins NL1, NL2 and NL3 were originally cloned in rats (Ichtchenko et al., Cell., 1995, 81(3):435-43; Ichtchenko et al., J. Biol. Chem., 1996, 271(5):2676-82). The neuroligins HNL1 and HNL2 are located on autosomes (3q26 and 17p13). These genes are targets for susceptibility to psychiatric diseases and several protein variations in HNL2 have been demonstrated by the inventors in autistic patients (R734H, G754R, A755V). A protein HNL4X (human neuroligin-4) has been described by Bollinger et al. (Biochem. J., 2001, 356:581-588), without any genomic description or related biological function. In addition, the LOCUSLINK™ database of Sep. 13, 2001 provides, under the accession numbers KIAA1260 and KIAA0951, incomplete sequences of a neuroligin gene, the function of which is also unknown. All neuroligins have an extracellular domain homologous with acetylcholine esterase (ACHE). Neuroligins interact with β-neurexins, at the level of this extracellular component (Ichtchenko et al., Cell., 1995, 81(3):435-43). This interaction can be modulated by ACHE itself (Grifman et al., Proc. Natl. Acad. Sci. USA, 1998, 95(23):13935-40). At the cytoplasmic level, neuroligins interact with several proteins containing PDZ domains (Irie et al., Sciences, 1997, 277(5331):1511-5; Hirao et al., J. Biol. Chem. 1998, 273(33), 21105-10; Kurschner et al., Mol. Cell Neurosci., 1999, 11(3): 161-72; Bolliger et al., Biochem J., 2001, 356:581-8; Toyooka et al., J Neurochem., 2002, 83(4):797-806). Among these proteins, are the proteins of the DLG1-5 family (3q29, 11q13, Xq13.1, 17p13.1 and 10q22.3), the S-SCAM protein (7q21.11), the proteins of the CIPP family (MPDZ, 9p23 and INADL, 1p31) and the CASK protein (Xp11).

In view of the above, it is clear that knowledge of the molecular bases of autism, and most particularly of the gene involved in the disease, is greatly desired in order to make it possible to develop novel therapeutic approaches, novel medicinal products and diagnostic tests.

A need also exists concerning identification of the biological function of neuroligins and also identification of the nucleic acid and protein sequence of neuroligins, in particular that of HNL3 and HNL4X.

The present invention satisfies these needs and other needs, as will be apparent to those skilled in the art upon reading the present description of the invention.

SUMMARY OF THE INVENTION

The present invention relates to the identification of human genes and of their murine ortholog encoding a protein involved in synaptogenesis, the mutation of which is associated, in humans, with the development of neurological diseases and/or with a predisposition to the development of mental disorders or psychiatric diseases such as autism and Asperger syndrome.

More particularly, a subject of the present invention is an isolated or purified polynucleotide encoding a polypeptide involved, in its wild-type form, in synaptogenesis. The polynucleotide of the present invention is characterized in that at least one mutation in the nucleic acid sequence of said polynucleotide is associated with the development of neurological diseases and/or with a predisposition to the development of mental disorders or psychiatric diseases.

Preferably, the present invention relates to a polynucleotide encoding a protein belonging to the family of human neuroligins (HNLs), and more particularly the HNL4X protein (previously called HNL4) and its functional homolog HNL4Y (previously called HNL5) encoded by a gene on the Y chromosome.

The present invention also relates to a polynucleotide encoding the mouse protein MNL4, which is the orthologs of the HNL4X and HNL4Y proteins.

According to another subject, the present invention is directed toward an isolated or purified polypeptide, characterized in that it is encoded by a polynucleotide as defined above. More particularly, the polypeptide according to the present invention is characterized in that it is involved in synaptogenesis, and in that the presence of at least one mutation in the amino acid sequence of said polypeptide is associated with a predisposition to the development of mental disorders or psychiatric diseases.

According to another subject, the present invention proposes a method for detecting biochemical disorders which alter synapse formation, and/or a predisposition to the development of psychiatric pathologies and/or a mental disease, comprising at least one of the following steps:

detecting a mutation in the sequence of a polynucleotide as defined above, in the sequence of a fragment of said polynucleotide or in the sequence of a messenger RNA of said polynucleotide;

detecting the presence of a polypeptide as defined above;

detecting a mutation in a polypeptide as defined above;

measuring the activity of a polypeptide as defined above or the interaction thereof with one of its protein partners.

Another object of the invention is to provide a kit for detecting biochemical disorders which alter synapse formation, and/or a predisposition to the development of psychiatric pathologies and/or a mental disease, and/or for diagnosing a mental disease, the kit comprising at least one of the elements chosen from the group consisting of: a probe, an antibody, a reagent and a solid support for:

i) detecting a mutation in the sequence of a polynucleotide as defined above, in the sequence of a fragment of said polynucleotide or in the sequence of a messenger RNA of said polynucleotide; and/or ii) measuring the biological activity of a polypeptide as defined above or the interaction thereof with one of its protein partners.

The invention also relates to the use of a nonmutated polynucleotide encoding a protein involved, in its wild-type form, in synaptogenesis, for treating or preventing biochemical pathologies or mental diseases.

The invention also relates to the use of a nonmutated polypeptide involved, in its wild-type form, in synaptogenesis, for treating or preventing biochemical pathologies or mental diseases.

The present invention also proposes a method for sorting molecules which makes it possible to modulate the biological activity of the polypeptide encoded by the polynucleotide defined above or the biological activity of the polypeptide defined above, comprising:

a) bringing said polypeptide or a recombinant cell containing it into contact with a molecule capable of modulating its biological activity;

b) measuring the biological activity of said polypeptide or its interaction with one of its protein partners; and c) evaluating the activity measured in step b) relative to a measurement of the biological activity of said polypeptide in the absence of said molecule.

Another subject of the present invention is directed toward a method for treating a mental or neurological disease, comprising the insertion into at least one portion of the cells from an affected patient of a polynucleotide encoding a polypeptide as defined above.

The present invention also proposes a method for transforming stem cells from a patient exhibiting a mutation of a gene encoding a protein involved in synaptogenesis, characterized by a) the use of stem cells from said patient;

b) the insertion into the genome of said stem cells of a polynucleotide as defined above; and c) the reimplantation into the patient of cells transformed according to step b).

The invention also relates to a cloning or expression vector comprising one of the polynucleotides of the invention or a fragment thereof; a host cell containing a polynucleotide and/or a vector according to the invention; or purified monoclonal or polyclonal antibodies which recognize specifically at least one of the polynucleotides of the invention and/or at least one of the polypeptides of the invention.

The invention is also directed toward a composition containing at least one element chosen from the group consisting of a) a polypeptide, b) a polynucleotide, c) a vector, d) a host cell and e) an antibody, and a pharmaceutically acceptable vehicle.

BRIEF DESCRIPTION OF THE DRAWINGS

Figure 2:
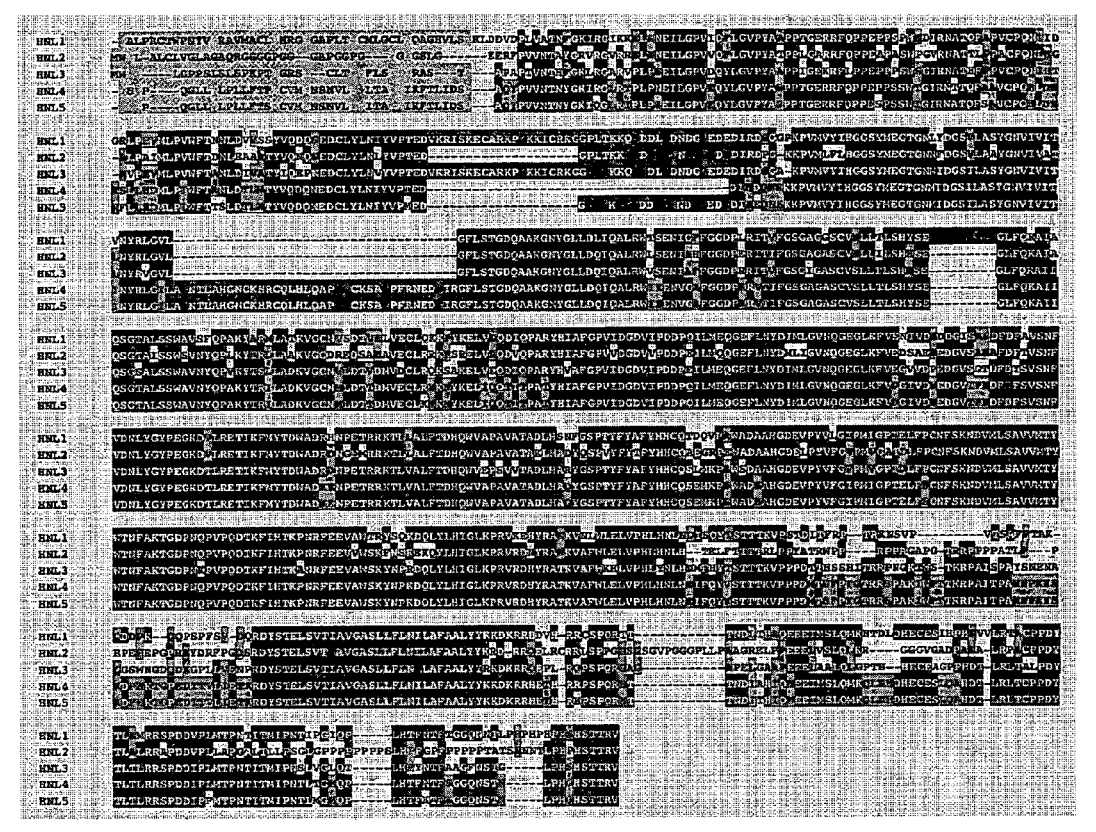

FIG. 2 shows a protein alignment for human neuroligins (HNL1-SEQ ID NO:64; HNL2-SEQ ID NO:65; HNL3-SEQ ID NO:66; HNL4-SEQ ID NO:67; HNL5-SEQ ID NO:6).

FIG. 3 is a diagram which shows the protein architecture of the synapse with the location and the known partners of neuroligins.

FIGS. 4A and 4B represent a diagram which shows the chromosomal location and the evolution of the HNL4X and HNL4Y genes.

FIG. 8A-1 to FIG. 8A-66 represent the genomic sequence (SEQ ID NO:1) of the wild-type (nonmutated) human HNL4X gene.

FIG. 8B-1 to FIG. 8B-2 represent the nucleic acid sequence (SEQ ID NO:16) of exon 1 of FIG. 8A.

FIG. 9A-1 to FIG. 9A-2 represent the complementary DNA sequence (SEQ ID NO:2) of the wild-type (nonmutated) human HNL4X gene.

FIG. 10 represents the amino acid sequence (SEQ ID NO:3) of the wild-type (nonmutated) human HNL4X protein.

FIG. 11A represents the genomic sequence (SEQ ID NO:4) of the human HNL4Y gene.

FIG. 11B represents the nucleic acid sequence (SEQ ID NO:17) of exon 1 of FIG. 11A.

FIG. 12 represents the complementary DNA (cDNA) sequence (SEQ ID NO:5) of the wild-type human HNL4Y gene.

FIG. 13 represents the amino acid sequence (SEQ ID NO:6) of the wild-type human HNL4Y protein.

FIG. 14 represents the complementary DNA (cDNA) sequence (SEQ ID NO:7) of an alternative transcript of the wild-type human HNL4Y gene.

FIG. 15 represents the amino acid sequence (SEQ ID NO:8) corresponding to the alternative sequence of FIG. 14.

FIG. 16 represents the amino acid sequence (SEQ ID NO:9) of the mutated human HNL4X protein.

FIG. 18 is a diagram which shows the conservation of the HNL3 mutations (Neuroligins-SEQ ID NOS:68-74; Acetylcholine esterase-SEQ ID NO:75-88; Butyrylcholine esterase-SEQ ID NOS:89-92; HNL3 N796S-SEQ ID NOS93-98).

FIG. 19A shows the nucleic acid sequence of the cDNA of MNL4 (SEQ ID NO:62) (orthologs of HNL4X and HNL4Y).

FIG. 19B represents the amino acid sequence of the MNL4 protein (SEQ ID NO:63).

FIG. 20 is a diagram which shows the genomic structure of the HNL1, HNL2 and HNL3 genes, and also the location of the mutations observed in HNL3.

FIG. 22 shows a portion of the amino acid sequence (SEQ ID NO:10) of the HNL3 protein mutated at position 451.

FIG. 23 shows another portion of the amino acid sequence (SEQ ID NO:11) of the HNL3 protein mutated at position 796.

FIG. 24 represents the complementary DNA (cDNA) sequence (SEQ ID NO:12) of the wild-type HNL3 transcript.

FIG. 25 represents the complementary DNA (cDNA) sequence (SEQ ID NO:13) of the mutated HNL3 transcript.

FIG. 26 represents the amino acid sequence (SEQ ID NO:14) of the wild-type human HNL3 protein.

FIG. 27 represents the amino acid sequence (SEQ ID NO:15) of the mutated human HNL3 protein.

DETAILED DESCRIPTION OF THE INVENTION

Figure 1:
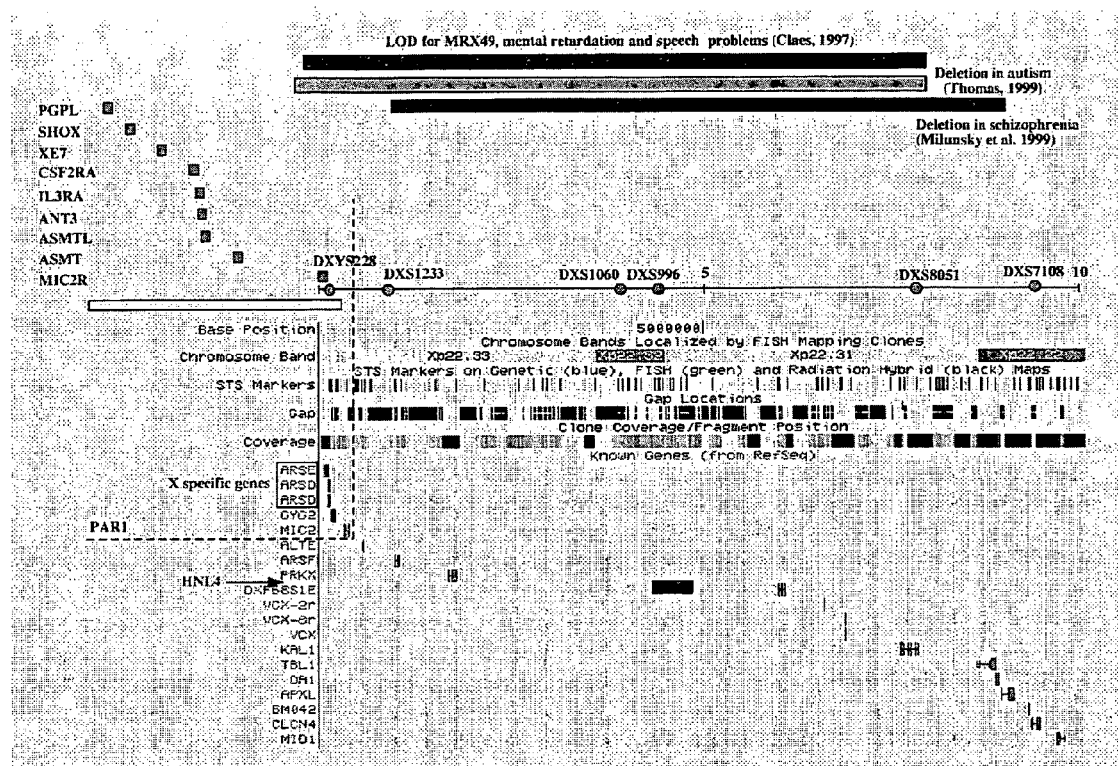
FIG. 1 shows the region of chromosome Xp22.3 containing the HNL4X gene.
Figure 5:
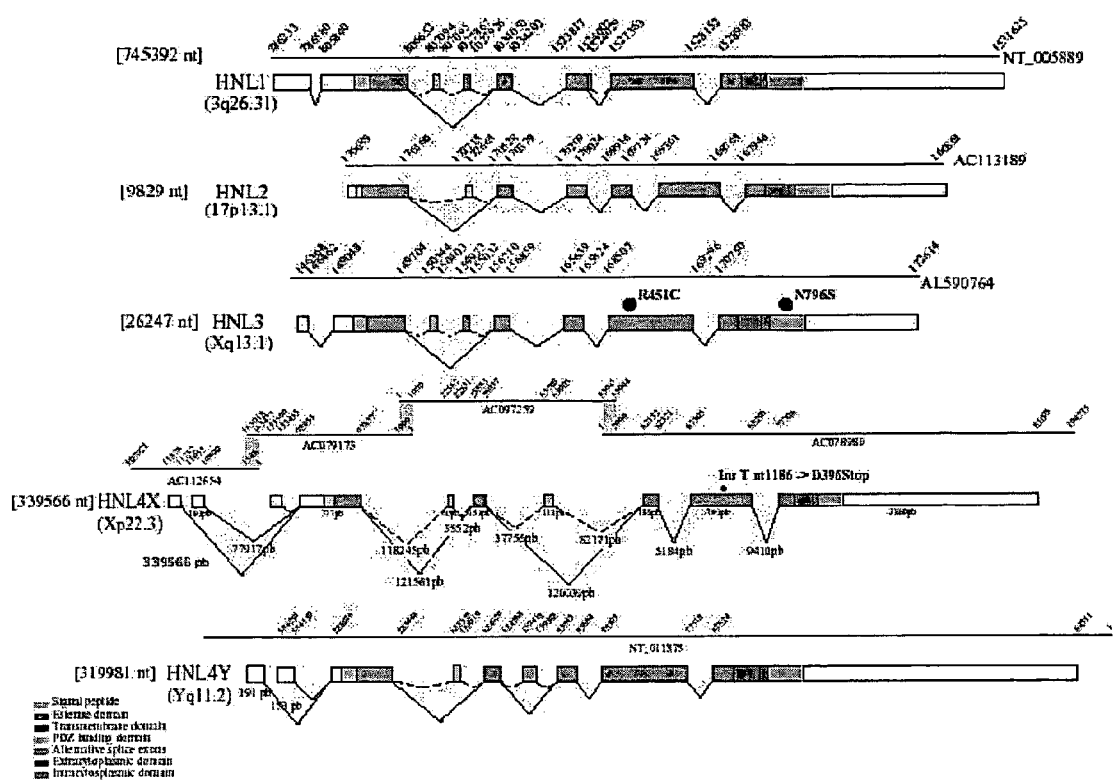
FIG. 5 is a diagram which shows the genomic structure of the human neuroligin genes.

The originality of the present invention relates to the identification of the genomic sequence of the HNL4X gene located at Xp22.3 and of a functional homolog HNL4Y placed on the Y chromosome, located at Yq11.22, and also their murine orthologs MNL4.

The invention also relates to the identification of the involvement of the proteins of synaptogenesis, in particular HNL3 and HNL4, in the development of mental disorders or psychiatric diseases such as autism.

1. Polypeptide and Polynucleotide

According to a first aspect, the present invention is directed toward an isolated or purified polypeptide which, in its wild-type (i.e. nonmutated) form, is involved in synaptogenesis, in which at least one mutation in the amino acid sequence is associated with the development of neurological diseases and/or with a predisposition to the development of mental disorders or psychiatric diseases.

The expression "mental disorders or psychiatric diseases" is intended to mean diseases such as autism, Asperger syndrome, schizophrenia and ADHD (attention deficit hyperactivity disorder) syndrome.

Preferably, the polypeptide consists of a cell adhesion protein, more preferably of a protein belonging to the human neuroligin family, and even more preferably the polypeptide consists of the HNL3 protein, HNL4X or the HNL4Y protein. Advantageously, when the polypeptide is HNL3, it comprises an amino acid sequence according to SEQ ID NO:14 and sequences of at least 20, of at least 50 and of at least 100 consecutive amino acids or more derived from SEQ ID NO:14. When the polypeptide of the invention is HNL4X or the HNL4Y protein, it comprises a sequence chosen from the group consisting of: SEQ ID NO:3, SEQ ID NO:6, SEQ ID NO:8 and the sequences of at least 20, of at least 50 and of at least 100 consecutive amino acids or more derived from SEQ ID NO:3, SEQ ID NO:6 or SEQ ID NO:8.

The invention also relates to the "mutated" polypeptides and the polypeptides "derived" from the wild-type protein, preferably a neuroligin such as HNL3, HNL4X or HNL4Y.

The term "polypeptide derived" from a wild-type protein or "variant" of a wild-type protein is intended to mean all peptides which have a peptide sequence substantially identical, at least in part, to the peptide sequence of the wild-type protein. They may, for example, be chemically modified polypeptides having a peptide sequence 100% identical to a portion of the wild-type protein. They may also be hybrid polypeptides having a first portion 100% identical to a first portion of the wild-type protein and a second portion in no way/partially identical to a second portion of the wild-type protein. They may also be polypeptides having complete/partial homology with a portion of the wild-type protein.

The term "mutated" polypeptides derived from a wild-type protein is intended to mean all peptides which have been obtained following modification of said wild-type protein, whether this is modification by addition, deletion or substitution of one or more of the amino acids of the wild-type protein. It may also be a modification introduced by the addition of carbon chains attached to at least one of the amino acids of the wild-type protein or to at least one of the amino acids of the peptides for which there exists a substitution or a modification of one of the amino acids compared to the wild-type protein. More particularly, the present invention covers the peptides which derive from the human protein HNL3, HNL4X or HNL4Y.

According to a preferred embodiment, and when the polypeptide is a mutated HNL3 according to the present invention, it has SEQ ID NO:10, SEQ ID NO:11 or SEQ ID NO:15, and a sequence of at least 20, of at least 50 and of at least 100 consecutive amino acids or more derived from SEQ ID NO:10, SEQ ID NO:11 or SEQ ID NO:15. When the polypeptide is a mutated HNL4X or a mutated HNL4Y according to the present invention, it has SEQ ID NO:9 or a sequence of at least 20, of at least 50 and of at least 100 consecutive amino acids or more derived from SEQ ID. NO:9.

The invention is also directed toward the polypeptides (and the fragments thereof) which are encoded by the nucleotide sequences mentioned hereinafter.

In the context of the present invention, the term "polypeptide" is defined as being any peptide or protein comprising at least two amino acids linked by a modified or unmodified peptide bond. The term "polypeptide" refers to short-chain molecules such as peptides, oligopeptides or oligomers or to long-chain molecules such as proteins. A polypeptide according to the present invention can comprise modified amino acids. Thus, the polypeptide of the present invention can also be modified by a natural process such as post-transcriptional modifications or by a chemical process. Some examples of these modifications are: acetylation, acylation, ADP-ribosylation, amidation, covalent bonding with flavine, covalent bonding with a heme, covalent bonding with a nucleotide or a nucleotide derivative, bonding with a lipid or a lipid derivative, covalent bonding with a phosphotidylinositol, cross-linking, cyclization, disulfide bond formation, demethylation, cysteine molecule formation, pyroglutamate formation, formylation, gamma-carboxylation, hydroxylation, iodination, methylation, oxidation, phosphorylation, racemization, hydroxylation, etc. Thus, any modification of the polypeptide which does not have the effect of eliminating the biochemical characteristics of the polypeptide of origin, i.e. the ability to form functional synapses, is covered within the scope of the present invention.

According to a related aspect, the invention is directed toward an isolated or purified polynucleotide encoding a polypeptide as defined above, and more particularly an isolated or purified polynucleotide encoding a polypeptide involved in synaptogenesis, in which at least one mutation of this polypeptide is associated with the development of neurological diseases and/or with a predisposition to the development of mental diseases or psychiatric diseases.

The term "isolated or purified" is intended to mean the molecules which have been altered, by man, from their natural state, i.e., if such a molecule exists naturally, it has been changed and/or removed from its initial environment. For example, a polynucleotide or a polypeptide naturally present in a living organism is not "isolated". However, the same polynucleotide or polypeptide, when separated from its normal environment and/or obtained by cloning, amplification and/or by chemical synthesis, is considered according to the present invention as being "isolated". Moreover, a polynucleotide or polynucleotide which is introduced into an organism by transformation or genetic manipulation or by any other method of recombination is "isolated" even if it is present in said organism.

The term "polynucleotide" is intended to mean any DNA or RNA molecule or sequence having two nucleotides or more, including the nucleic acid sequences encoding an entire gene. The term "polynucleotide" encompasses all nucleic acid molecules which are in the natural or artificial state. This includes DNA molecules, RNA molecules, cDNAs, expressed sequences (ESTs), artificial sequences and all the fragments thereof. It goes without saying that the "derived", "variant" and "mutated" definitions also apply to the polynucleotides according to the present invention. Any polynucleotide which has been chemically, enzymatically or metabolically modified but which has conserved the biochemical properties of the polypeptide of origin, i.e. which has conserved its ability to form functional synapses, is included in the scope of the present invention.

According to a preferred embodiment, when the polynucleotide according to the invention encodes an HNL3 protein or a fragment of this protein, the latter advantageously comprises SEQ ID NO: 14. Preferably, the polynucleotide comprises a sequence chosen from the group consisting of : SEQ ID NO: 12 and the sequences of at least 20, of at least 50 and of at least 100 consecutive nucleotides or more derived from SEQ ID NO: 12.

According to a preferred embodiment, when the polynucleotide according to the invention encodes an HNL4X or HNL4Y protein or a fragment of this protein, the latter advantageously comprises SEQ ID NO:3, SEQ ID NO:6 or SEQ ID NO:8. Preferably, the polynucleotide comprises a sequence chosen from the group consisting of: SEQ ID NO:1, SEQ ID NO:2, SEQ ID NO:4, SEQ ID NO:5, SEQ ID NO:7, SEQ ID NO:16, SEQ ID NO:17 and the sequences of at least 20, of at least 50 and of at least 100 consecutive nucleotides or more derived from these sequences.

Figure 6:
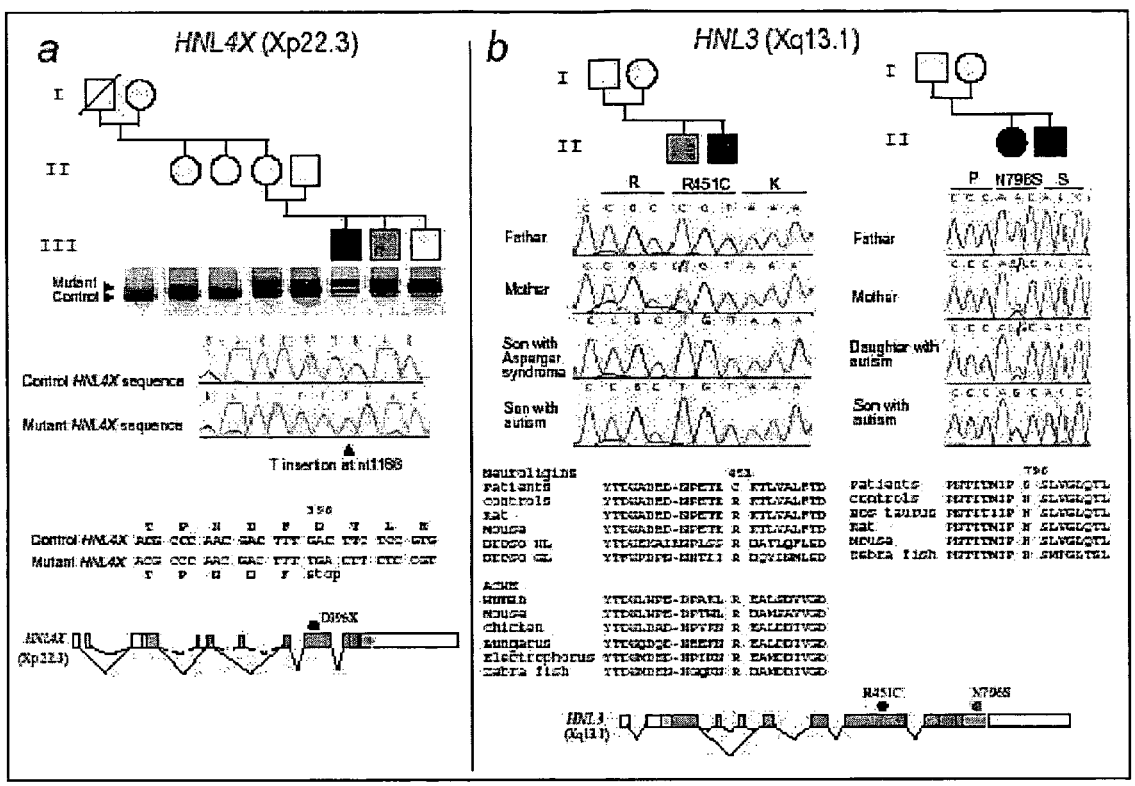
FIGS. 6A and 6B show the result of SSCP (single strand conformational polymorphism) analysis of a mutation of the gene encoding the HNL4X protein and also the sequence of this mutation.
Figure 7:
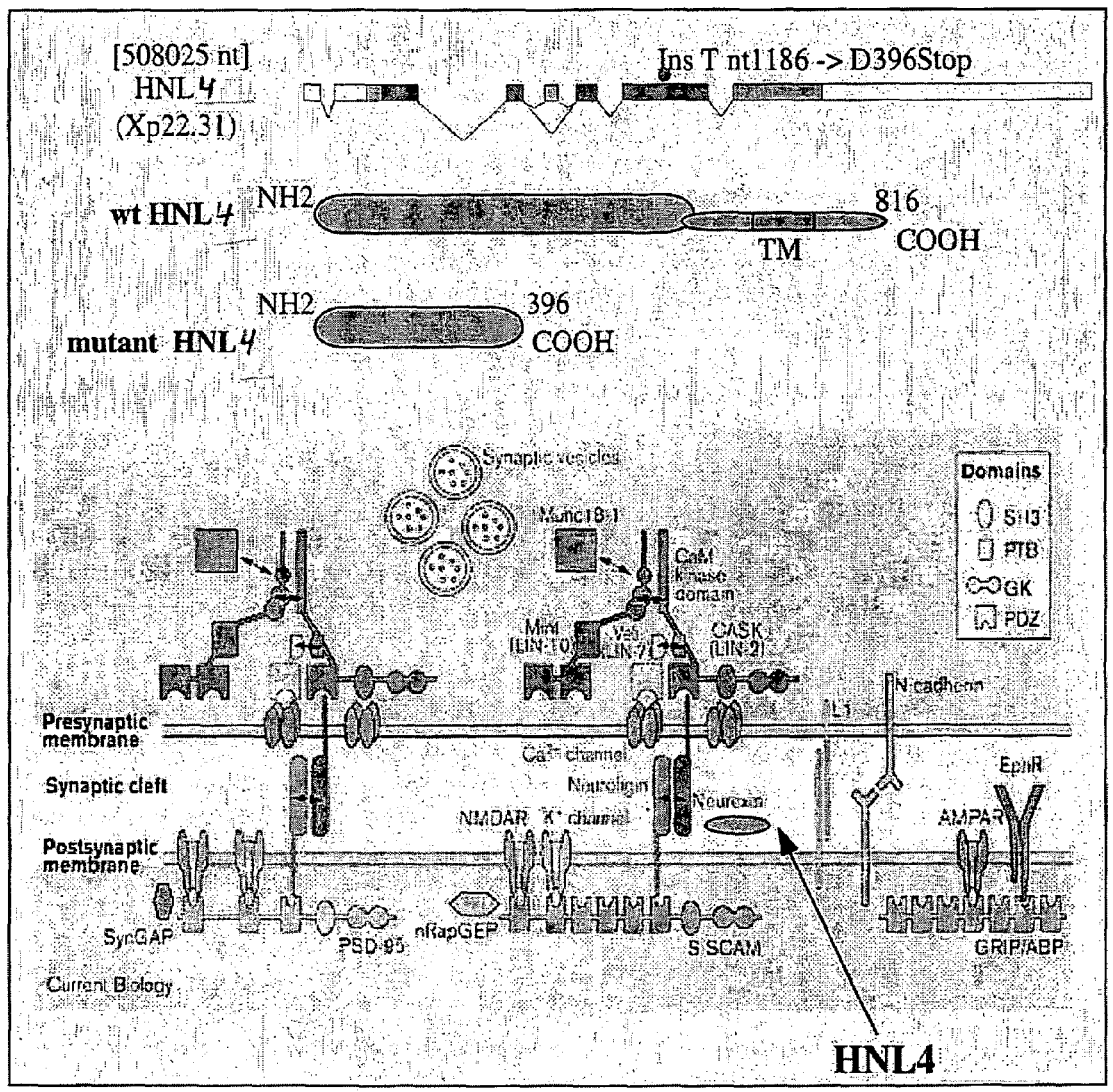
FIG. 7 is a diagram which shows the location of the HNL4X protein and the effects of the mutation on HNL4X.
Figure 21:
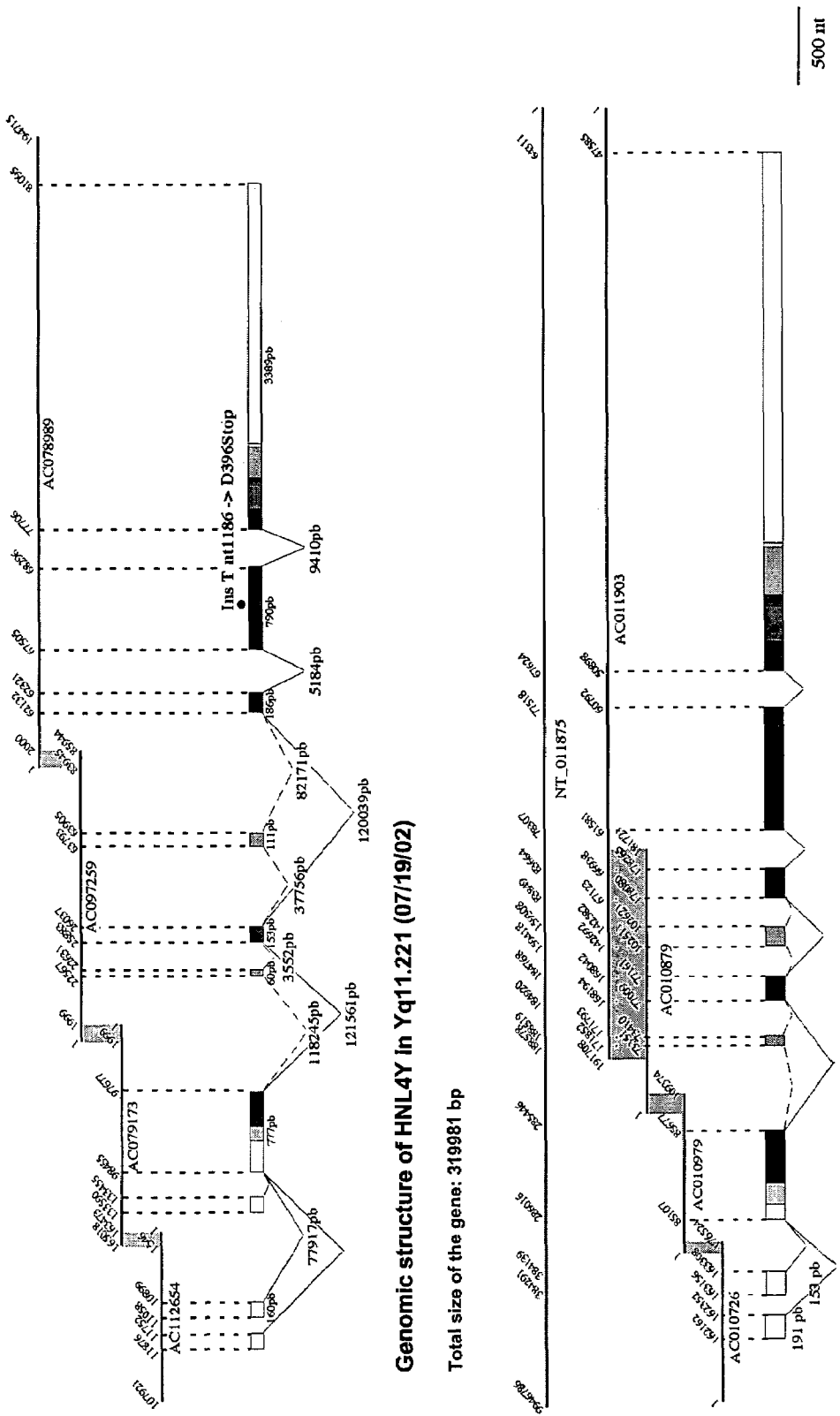
FIG. 21 is a diagram which shows the genomic structure of HNL4X and HNL4Y.

According to another embodiment, the polynucleotide encodes a nonfunctional mutated protein. Preferably, the polynucleotide encodes a mutated HNL3 or mutated HNL4X protein. When the protein is HNL4X, the polynucleotide is mutated such that the mutation causes early termination of the protein. More preferably, the polynucleotide of the invention comprises SEQ ID NO:1 and the mutation is an insertion of a thymine at position 1186, from position 465 of FIG. 9 (ORF). This mutation causes the production of a defective protein lacking its transmembrane portion since this mutation causes early termination of the protein (D396stop). When the mutated protein is HNL3, the mutation causes a modification of the protein sequence such as an amino acid substitution at position 451 and/or 796 of FIG. 18 or 21. More particularly, the mutation produced at position 451 consists of the substitution of an arginine with a cysteine, while the mutation produced at position 796 consists of the substitution of an asparagine with a serine. This amino acid, arginine R451, is located in the acetylcholine esterase domain of the neuroligins and is extremely conserved in all the neuroligins sequenced to date and in fish, bird and reptile acetylcholine esterases (FIGS. 6A and 6B).

The polypeptides and polynucleotides according to the present invention can be prepared by any suitable method. They can in particular be obtained by chemical synthesis, but it is also possible to obtain them biologically, using in particular various vectors in suitable cell cultures, as will be described hereinafter. The peptides according to the present invention can be in deglycosylated or glycosylated form, if this is necessary. Those with knowledge in the field of the invention will be able to obtain various polynucleotides/polypeptides and will also be able to determine which, among the polynucleotides/polypeptides obtained, are those which have an appropriate biological activity.

2. Vector, Antibody and Cell

According to another aspect, the invention relates to any vector (cloning and/or expression vector) and any cellular host (procaryotic or eukaryotic) transformed with such a vector, and comprising the regulatory elements for expression of the nucleotide sequence encoding a peptide according to the invention.

According to another aspect, a subject of the invention is a method for preparing a peptide of the invention, by transformation of a cellular host using an expression vector (plasmid, cosmid, virus, etc.) comprising the DNA sequences encoding the peptides of the invention, followed by culturing of the cellular host thus transformed, and recovery of the peptide from the culture medium. The use of vectors for the expression of proteins and peptides in the cells of host, in particular humans, is well known and will not be described in further detail.

The polypeptides and polynucleotides of the present invention can also be used to prepare polyclonal or monoclonal antibodies capable of binding (preferably specifically) to at least one polypeptide/polynucleotide which is a subject of the invention. The present invention is therefore also directed toward such purified antibodies which can be obtained by very well-known techniques such as, for example, the technique described by Kohler and Milstein (Continuous cultures of fused cells secreting antibody of predefined specificity, Nature, 1975, 262:495-497). According to a preferred embodiment of the invention, the antibodies are of the "humanized" type. Those skilled in the field, by virtue of their general knowledge, will know how to prepare these types of antibodies.

In the context of the present invention, the term "vector" refers to a polynucleotide construct designed to be transfected into various cell types. As a result, these vectors are directed toward expression vectors designed for the expression of a nucleotide sequence in a host cell; cloning vectors designed for the isolation, propagation and replication of inserted nucleotides; viral vectors designed for the production of recombinant virus or of viral particle (viral-like particle); or shuttle vectors which comprise attributes of more than one vector.

3. Methods and Process for Use

According to another aspect, the invention relates to the treatment or prevention of biochemical pathologies or mental diseases such as autism or Asperger syndrome. More particularly, the invention is directed toward the use of a nonmutated polynucleotide encoding a protein involved in synaptogenesis. Preferably, the protein consists of a cell adhesion protein, more preferably of a protein belonging to the human neuroligin family, and even more preferably the polypeptide consists of the HNL3 protein, HNL4X or the HNL4Y protein. Examples of nonmutated polynucleotides are given above.

The invention is also directed toward a method of treatment comprising the insertion into at least one portion of the cells from an affected patient of a polynucleotide encoding a polypeptide involved in synaptogenesis, such as the HNL3 or HNL4X protein. Preferably, the cells into which the polynucleotide is inserted are stem cells. Examples of satisfactory polynucleotides are given above.

According to a related aspect, the invention is directed toward a method for transforming stem cells from a patient exhibiting a mutation of a gene encoding a protein involved in synaptogenesis, the method comprising:
a) the use of stem cells from the patient;
b) the insertion into the genome of the stem cells, of a polynucleotide encoding a functional polypeptide involved in synaptogenesis, such as the HNL3 or HNL4X protein; and
c) the reimplantation into the patient of cells transformed according to step b).

Those skilled in the field will be able to adapt the treatment methods mentioned above and to determine, according to several factors, the polynucleotides which should be used, the means for inserting them into the cells and the method and the amount of polynucleotides or of cells which should be administered. Among the factors which can influence their choices are: the nature of the treatment; the exact sequence of the polynucleotides; the stage of the disease; the condition, the age and the weight of the patient, etc.

According to another aspect, the invention also relates to a method for detecting biochemical disorders which alter synapse formation, stabilization and/or recognition, a predisposition to the development of psychiatric pathologies and/or a mental disease such as autism or Asperger syndrome.

Thus, the method comprises at least one of the following steps:
detecting a mutation in the sequence of a gene encoding a protein involved in synaptogenesis, in the sequence of a fragment of this gene or in the sequence of a messenger RNA of this gene;
detecting the presence of a protein involved in synaptogenesis;
detecting a mutation in a protein involved in synaptogenesis;
measuring the biological activity of a protein involved in synaptogenesis or its interaction with one of its protein partners. A method for measuring such an interaction is, for example, described in Ichtchenko et al. (J. Biol. Chem., 1996, 271(5):2676-82) or Grifman et al. (Proc. Natl. Acad. Sci. USA, 1998, 95(23):13935-40).

According to a preferred embodiment, the method comprises:
a) amplifying a gene encoding a protein involved in synaptogenesis, amplifying a fragment of said gene or amplifying a messenger RNA of said gene; and
b) detecting a mutation in the sequence of said gene, in the sequence of said fragment or in the sequence of said messenger RNA.

A related aspect of the method of the invention concerns a kit (set) for detecting biochemical disorders which alter synapse formation, a predisposition to the development of psychiatric pathologies and/or a mental disease, and/or for diagnosing a mental disease. According to a preferred embodiment, the kit comprises at least one of the elements chosen from the group consisting of: a probe, an antibody, a reagent and a solid support, these elements allowing:
i) detection of a mutation in the sequence of a gene encoding a protein involved in synaptogenesis, in the sequence of a fragment of this gene or in the sequence of a messenger RNA of this gene; and/or
ii) measurement of the biological activity of a protein involved in synaptogenesis or of its interaction with one of its protein partners.

Preferably, the gene to which reference is made in the method and the kit encodes, in its wild-type form, a cell adhesion protein, more preferably a protein belonging to the human neuroligin family, and even more preferably the HNL3 protein, the HNL4X protein or the HNL4Y protein.

Advantageously, the gene encodes, in its wild-type form, a protein comprising SEQ ID NO:3, SEQ ID NO:6, SEQ ID NO:8 or SEQ ID NO:14. More preferably, the gene comprises SEQ ID NO:1, SEQ ID NO:4 or SEQ ID NO:12.

Knowledge of the gene involved in a predisposition to the development of autism or of Asperger syndrome opens the door to the discovery of novel molecules for preventing, controlling or treating the disease. Thus, according to another aspect, the invention is directed toward a method for sorting molecules which can make it possible to modulate the biological activity of a polypeptide encoded by the polynucleotide as defined above, or the biological activity of the polypeptide as defined above. According to a preferred embodiment, the sorting method comprises:
a) bringing said polypeptide into contact with a molecule capable of modulating its biological activity;
b) measuring the biological activity of said polypeptide; and
c) evaluating the activity measured in step b) relative to a measurement of the biological activity of said polypeptide in the absence of said molecule.

4. Compositions

The present invention also relates to the use of these polypeptides and of the polynucleotides encoding them, for preparing therapeutic compositions that are useful in the treatment of a mental or neurological disease, such as autism, Asperger syndrome, schizophrenia or ADHD syndrome.

In a preferred embodiment, the composition of the present invention also contains a pharmaceutically acceptable vehicle, and an element chosen from the group consisting of:
a polynucleotide according to the present invention;
a polypeptide according to the present invention;
an antibody according to the present invention;
a vector according to the present invention; and
a host cell according to the present invention.

The compositions according to the present invention can be in any solid or liquid form that is usual for pharmaceutical administration, i.e., for example, liquid administration forms or administration forms consisting of a gel, or any other support allowing, for example, controlled release. Among the compositions which can be used, mention may in particular be made of injectable compositions more particularly intended for injections into the blood circulation in humans.

Those skilled in the field will be able to prepare pharmaceutically acceptable compositions and to determine, according to several factors, the preferred mode of administration and the amount which should be administered. Among the factors which can influence their choices are: the nature of the treatment; the exact nature of the active or non-active ingredients which make up the composition; the stage of the disease; the condition, the age and the weight of the patient, etc.

The examples hereinafter will make it possible to demonstrate other characteristics and advantages of the present invention.

EXAMPLES

The examples which follow serve to illustrate the extent of the use of the present invention and not to limit its scope. Modifications and variations can be made thereto without departing from the spirit or from the scope of the invention. Although other methods or products equivalent to those which are found above may be used for testing or implementing the present invention, the preferred materials and methods are described.

Introduction

A locus for predisposition to autism has been suggested in Xp22.3 by the observation of several independent and de novo chromosomal deletions in this region. The size of the critical region deleted in these patients was approximately 10 Mb, delimited by DXYS232X (6 cM) and DXS7103 (16 cM). In support of these results, the overall analysis of the genome carried out by the Paris study (Philippe et al., 1999) indicates that the maximum LOD for the X chromosome is located in this region (11 cM).

Within this interval, we have identified the human neuroligin 4 (HNL4X) gene encoding a new member of the neuroligin family (Scheiffele et al., 2000; Song et al., 1999). These cell adhesion molecules possess a homology with acetylcholine esterases and are specifically located in the postsynaptic membrane of excitatory synapses (Song et al., 1999). They are essential factors for the formation of functional synapses since the expression of neuroligins in HeLa cells or kidney cells can trigger the development of presynaptic structures in neurons which are in contact (Scheiffele et al., 2000). We have identified five HNL genes in the human genome, located on chromosomes 3q26 (HNL1), 17p13 (HNL2), Xq13 (HNL3), Xp22.3 (HNL4X) and Yq11.2 (HNL4Y). Neuroligin phylogeny suggests that HNL3 is the common ancestor of HNL4X and HNL4Y. The expression profile for the HNLs has been determined by specific RT-PCRs in various adult (male and female) brain tissues. Expression of the HNL1-3 genes and of their alternative transcripts is found in all brain regions. HNL4X and HNL4Y are expressed at similar levels in the male brain without significant differences between the various tissues. As expected, HNL4Y is not expressed in the female brain, whereas HNL4X is expressed.

Example 1

Characterization of the HNL4X and HNL4Y Genes and their Involvement in Psychiatric Syndromes The phylogenetic study shows that the HATL4X genes located on the X chromosome and the HNL4Y gene located on the Y chromosome began to diverge approximately 40 million years ago, during the evolution of primates. While all the genes of the Y chromosome which diverged at this date became pseudogenes (inactive genes), HNL4Y is strongly conserved (table 1).

TABLE 1

Conservation of the HNL4X and HNL4Y genes during evolution

| Gene pair | Ks | KA | Ks/KA | DNA divergence (%) | Protein divergence (%) | Compared sequence (nucleotides) |
|---|---|---|---|---|---|---|
| Group 4 | | | | | | |
| GYG2/GYG2P* | 0.11 | 0.06 | 1.8 | 7 | 12 | 525 |
| ARSD/ARSDP* | 0.09 | 0.07 | 1.3 | 7 | 13 | 846 |
| ARSE/ARSEP* | 0.05 | 0.04 | 1.2 | 4 | 9 | 615 |
| PRKX/Y | 0.07 | 0.03 | 2.3 | 5 | 8 | 1020 |
| HNL4X/4Y | 0.079 | 0.012 | 6.456 | 3 | 2 | 2451 |
| STS/STSP* | 0.12 | 0.10 | 1.2 | 11 | 18 | 852 |
| KAL1/KALP* | 0.07 | 0.06 | 1.2 | 6 | 12 | 1302 |
| AMELX/Y | 0.07 | 0.07 | 1.0 | 7 | 12 | 576 |
| Group 3 | | | | | | |
| TB4X/Y | 0.29 | 0.04 | 7.3 | 7 | 7 | 135 |
| EIF1AX/Y | 0.32 | 0.01 | 32 | 9 | 2 | 432 |
| ZFX/Y | 0.23 | 0.04 | 5.8 | 7 | 7 | 2394 |
| DFFRX/Y | 0.33 | 0.05 | 6.6 | 11 | 9 | 7671 |
| DBX/Y | 0.36 | 0.04 | 9.0 | 12 | 9 | 1932 |
| CASK/CASKP* | 0.24 | 0.22 | 1.1 | 15 | 32 | 156 |
| UTX/Y | 0.26 | 0.08 | 3.3 | 12 | 15 | 4068 |
| Group 2 | | | | | | |
| UBE1X/Y | 0.58 | 0.07 | 8.3 | 16 | 13 | 693 |
| SMCX/Y | 0.52 | 0.08 | 6.5 | 17 | 15 | 4623 |
| Group 1 | | | | | | |
| RPS4X/Y | 0.97 | 0.05 | 19 | 18 | 18 | 792 |
| RBMX/Y | 0.94 | 0.25 | 3.8 | 29 | 38 | 1188 |
| SOX3/SRY | 1.25 | 0.19 | 6.6 | 28 | 29 | 264 |
| PCDHX/Y | 0.006 | 0.008 | 0.809 | 1 | 2 | 2850 |

This table includes the synonymous substitution rates (KS) and nonsynonymous substitution rates (KA) of all the known genes of the X chromosome having homology on the Y chromosome. The KS/KA ratio is an indication of the gene conservation. KS is the rate of synonymous substitution per synonymous site which represents the modifications which do not change the sequence of the protein. KA is the rate of nonsynonymous substitution per nonsynonymous site which represents the modifications which change the sequence of the protein. If the KS/KA ratio=1, then the gene is not conserved since there are as many synonymous modifications as there are nonsynonmyous modifications. This is the case for the X/Y pairs having a nonfunctional pseudogene on the Y chromosome (for example, KAL1/KALP*). If KS/KA>1, then the gene varies in the course of evolution but the protein is well conserved. This is the case for the HNL4/5 pair indicating that the genetic variation between these genes is subjected to a selection pressure which conserves the protein sequences of HNL4X and HNL4Y.

For the detection of mutations on the HNL4X gene, the following steps were used:

Materials and Methods

Identification of the Sequence of the HNL4X, HNL4Y and MNL4 Genes

The HNL4X and HNL4Y genes were isolated by computer analysis of the sequences of the Xp22.3 and Yq11.22 region and amplification of the complete transcripts from brain mRNA.

Computer Analysis

A systematic study of the genes of the Xp22.3 region, close to the DXS996 microsatellite, was carried out using the human genome sequencing data available through publicly available databases. The DXS996 microsatellite is the genetic marker which shows the most significant linkage with autism in the analysis by Philippe et al. (1999, mentioned above). We identified that this genetic marker was located in a putative gene (KIAA1260, and that a putative homolog, KIAA0951, of this gene existed, located on the Y chromosome. The partial sequence of the cDNAs of the genes encoding KIAA1260 and KIAA0951 was deduced from the genomic sequence. A (BLAST) sequence alignment analysis and a phylogenetic tree grouping together the other human neuroligins were effected so as to define that KIAA1260 and KIAA0951 are new members of the neuroligin family which we henceforth call HNL4X and HNL4Y.

Analysis of the HNL4X and HNL4Y Transcripts

Total RNA from human brains coming from various men (n=5) and women (n=5) was isolated from biopsies of frontal cortex. The complete cDNAs of the HNL4X and HNL4Y mRNAs were reverse transcribed, amplified and directly sequenced. The oligonucleotides used for the amplification and sequencing are indicated in tables 2 and 3.

Sequencing of the HNL4X and HNL4Y Genes in Autistic and Asperger Individuals

Each exon of the HNL4X and HNL4Y genes was amplified and sequenced from the genomic DNA. The name and the sequence of each primer are indicated in table 3.

TABLE 2

Names and sequences of the primers used to amplify and sequence the HNL4X and HNL4Y cDNAs

| Exons | | | | |
|---|---|---|---|---|
| Exons 1-6 | HNLXY1 | ACCCCGCGTGAAGATGAAATG | SEQ ID NO:18 | |
| | HNLXYE6dR | GAGGGATAGGARGGGAAATAG | SEQ ID NO:19 | |
| Exons 2-5 | HNLXYE2F | GGATGTGGATGCAGATTTGAA | SEQ ID NO:20 | |
| | HNLXY4 | GCTCTGAATGATGGCCTTCTG | SEQ ID NO:21 | |
| Exons 4-6 | HNLXY10 | TCCTGGATCAGATTCAAGCAC | SEQ ID NO:22 | |
| | HNLXYE6dR | GAGGGATAGGARGGGAAATAG | SEQ ID NO:23 | |
| Exons 2-6 | HNLXYE2F | GGATGTGGATGCAGATTTGAA | SEQ ID NO:24 | |
| | HNLXYE6dR | GAGGGATAGGARGGGAAATAG | SEQ ID NO:25 | |

For the degenerate primers, use of the universal code: M(AC), R(AG), W(AT), S(CG), Y(CT), K(GT), V(ACG), H(ACT), D(AGT), B(CGT), N(ACGT)

TABLE 3

Names and sequences of the primers used to sequence the HNL4X and HNL4Y genes

| Exons | Primers | Sequences | SEQ ID NO: |
|---|---|---|---|
| Exon 1a HNL4X | HNLXYE1aF | GAAACAACGAATTTCCTCCAAA | 26 |
| | HNLXYE1aR | AGTGAGGCTTTCCATCCTTTGC | 27 |
| Exon 1b HNL4X | HNLXE1F | ATTCTTTAAGAAAACTGTCAGC | 28 |
| | HNLXYE1R | CACGGGAAAGGGGTGCATGGA | 29 |
| Exon 1 HNL4Y | HNLYE1F | GGGGTGCTTCTTTTGGGAGGCT | 30 |
| | HNLXYE1R | CACGGGAAAGGGGTGCATGGA | 31 |
| Exon 2 HNLX/Y | HNLXYE2F | GGATGTGGATGCAGATTTGAA | 32 |
| | HNLXE2Rbis | GTATTGTTTTCTGTTCCAGTG | 33 |
| Exon 3 HNL4X/Y | HNLXYE3F | TGTGTTTCCGTACTTGGCTTT | 34 |
| | HNLXYE3R | GCTTAGTCATTCACATGATGAA | 35 |
| Exon 4 | HNLXYE4F | ACCAAAAATCTCTTGTGTTCT | 36 |

TABLE 3-continued

Names and sequences of the primers used to sequence the HNL4X and HNL4Y genes

| Exons | Primers | Sequences | SEQ ID NO: |
|---|---|---|---|
| HNL4x | HNLXYE4R | TTCTTGGTTCAGGGTATTTGC | 37 |
| Exon 4 HNL4Y | HNLYE4F | AACAAAAATGTCCTGTGTTCT | 38 |
| | HNLXYE4R | TTCTTGGTTCAGGGTATTTGC | 39 |
| Exon 5 HNL4X/Y | RNLXYE5dF | TGTCCRCAATTTTGCACCTGC | 40 |
| | HNLXYE5dR | AGGAYAGTGATACCCCAACA | 41 |
| Exon 6 RNL4X/Y | HNLXYE6Fbis | AGAGCAGATTGTAACTTCCTG | 42 |
| | HNLXYE6dR | GAGGGATAGGARGGGAAATAG | 43 |

For the degenerate primers, use of the universal code: M(AC), R(AG), W(AT), S(CG), Y(CT), K(GT), V(ACG), H(ACT), D(AGT), B(CGT), N(ACGT).

TABLE 4

Names and sequences of the primers used for the amplification of the MNL4 cDNA (57BL6 mouse)

| Primer | Sequence | SEQ ID NO: |
|---|---|---|
| MNL4F8 | CGTGACGAAACAGGAAGTGACC | 44 |
| MNL4R8 | GTAGCCAAGGCCCCTGCATGTC | 45 |

TABLE 5

Names and sequences of the primers used for the amplification of MNL4 in three PCRs of approximately 1 kb

| Primer | Sequence | SEQ ID NO: |
|---|---|---|
| MNL4F8 | CGTGACGAAACAGGAAGTGACC | 46 |
| MNL4R2 | AGCCGAAGACGGTGACGCGGTC | 47 |
| MNL4F12 | AGGAAGCCGGTCATGGTTTACA | 48 |
| MNL4R5 | ACGCTCAGCTCCGTCGAGTAGT | 49 |
| MNL4F14 | AGACGCTCGTGGCGCTCTTCAC | 50 |
| MNL4R8 | GTAGCCAAGGCCCCTGCATGTC | 51 |

TABLE 6

Names and sequences of the primers used for the amplification of HNL3

| PRIMER | SEQUENCE | SEQ ID NO: |
|---|---|---|
| RNL3E2F | CCTATTGGGCTGATGCTGTGACC | 52 |
| HNL3E2R | AGGGCACACAACCACATGCAAG | 53 |
| HNL3E3Fbis | TTGAGCTCCAGGTTGAGCAACC | 54 |
| HNL3E3RBIS | CCCCTTGCGAAGCCAGTCTTCC | 55 |
| HNL3E4F | CTGCGTGCTCATTCTCTATTCC | 56 |
| HNL3E4R | GTAGAAGAGAGCTGGCCGATTC | 57 |

TABLE 6-continued

Names and sequences of the primers used for the amplification of HNL3

| PRIMER | SEQUENCE | SEQ ID NO: |
|---|---|---|
| HNL3E5F | ATGGCTATGTGTGACACGACAG | 58 |
| HNL3E5R | GGAAGATGAGTGAAGGGGTACC | 59 |
| HNL3E6F | TTTCCTCATCCAGATAGAGTGG | 60 |
| HNL3E6R | CATGTGTTCCTGGATCTGGGAG | 61 |

In order to test this gene in autistic individuals, the genomic structure of the various HNLs was defined and the coding portions (Exon 2-Exon 6) were amplified.

Thus, 140 autistic boys and 18 autistic girls were tested for most of the HNL4X/4Y coding portion.

Figure 17:
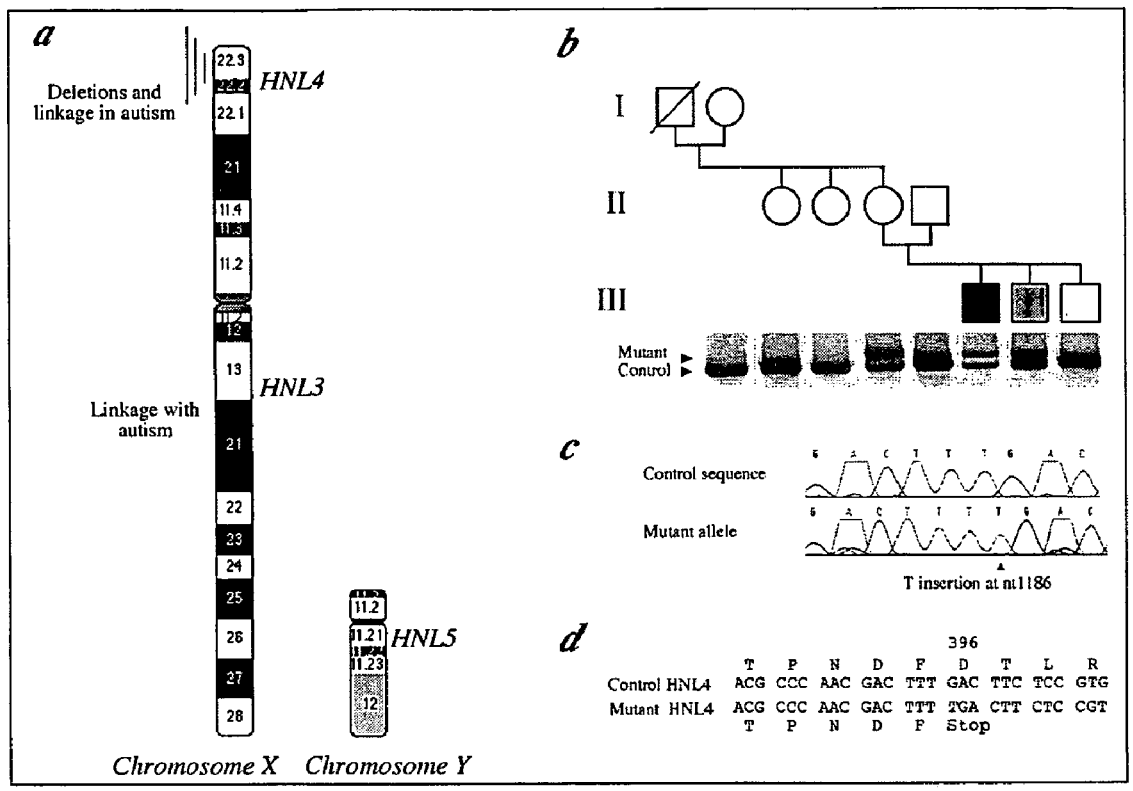
FIG. 17 shows the chromosomal location of the HNL3, HNL4X and HNL4Y genes and the pedigree of a family exhibiting a mutation in HNL4X in an autistic boy and a boy suffering from Asperger syndrome.

In a Swedish family with two affected brothers, one with autism and the other exhibiting Asperger syndrome, an additional thymidine was identified at nucleotide 1186 of the HNL4X gene, creating a stop codon (FIG. 17). This mutation (D396stop) is located in the esterase domain, producing a premature termination of the protein and deleting the transmembrane domain. This change is inherited from the mother, but is absent in the maternal grandmother, in the two maternal aunts and in the unaffected child, indicating the de novo status of this mutation in the mother of the affected boys. In addition, this mutation was not found in 350 controls (250 women and 100 men).

In addition, the boy/girl ratio, which is four for autism and nine for Asperger syndrome, corroborates this observation according to which HNL4X/4Y influences synaptogenesis and the mutation of HNL4X/4Y constitutes a factor for predisposition to mental diseases, in particular autism and Asperger syndrome.

The identification of this stop mutation in a primate-specific gene carried by the X chromosome in two autistic individuals, and involved in synaptogenesis, is one of the first functional mutations identified in a psychiatric disease. This mutation is also the first mutation described which is associated with autism without any other clinical sign (fragile X, tubercular sclerosis, etc.).

Example 2

Characterization of the HNL3 Gene and of Its Involvement in Psychiatric Syndromes During the search for mutations in HNL3, the ancestral gene for HNL4X/Y located in the Xq13 region, in two independent families, two amino acid changes located in highly conserved regions of the protein were identified. One of the two families is very similar to the first family mutated in HNL4X. The two affected brothers, the first affected with autism and the second with Asperger syndrome, received the mutation from their mother. Interestingly, the mother also has a brother with Asperger syndrome and other relatives with psychiatric disorders. The mutation (R451C) is located in the esterase domain of the protein and concerns an amino acid that is conserved during evolution since it is present in all neuroligins (including in *D. melanogaster*) and in all the mammalian, fish, reptile and bird acetylcholine esterases sequenced to date (see FIG. 6). The mutation is absent in 200 controls (100 women and 100 men). These results support the role of neuroligins in the etiology of mental disorders or psychiatric diseases such as autism and Asperger syndrome. MNL4, the orthologs of HNL4X in mice, was also identified. This new gene should make it possible to understand the deficiency induced by a mutation such as the HNL4X mutation in autism (see FIG. 19).

The final examination of the genome carried out on Finnish families with members suffering from autism (Auranen, et al., 2002) identified two very significant linkage peaks at 3q26 (exactly where HNL1 is located) and at Xq13-21 (exactly where HNL3 is located). The Xp22.3 region, containing HNL4X, is also deleted in two patients with schizophrenia. It is therefore possible that neuroligins are also responsible for susceptibility to this syndrome (schizophrenia affects 1% of the population).

SEQUENCE LISTING (98 sequences)

SEQ ID NO: 1 - DNA, 334462 bp, Homo sapiens
  exon (10670)..(10828)
  exon (83744)..(84513)
  exon (201676)..(201828)
  exon (240359)..(240469)
  exon (312940)..(313125)
  exon (318313)..(319102)
  exon (327018)..(330406)
ttgttgccattaccttttttttttttttttttttgtgagacggagtctcgctctatcacccaggctggagtgcagtggtgtgatctcagctcactgcgacttctgccgccaggtttcaagtgatcctccagcctcagccttctgagtagctgggactacaggtgcgcaccacaacaccctgctaatttttgtattttttagtagagagggggtctcaccatgttggcccggctgacatcgaactcctgaactcaagtgatccacctgccttggcctcccaaagtactagaattacaagcgtgagccactgtgcccagccctcagttacatttgaatatgagacaaacaaagaaaaaaccagcataattatatctcaaatattgcacaaaacattcttttagtaatgtttttgtgagtcctatatttttagctgttaaatctggcaaccctaggcccagatgtctgtgctaacgtctggtctatctaccacttagatagatacttgtgtggttataagctgtatacttgtgtagttataagccgaccacaccacttctcccagacagcttccttacataagtttcctatgacaaagcccctgtcttaatactgctcatcttctcgaagacgcattttaaaaaatccattaacacctttcatattaattagggcacttcctgtgcaagtaacataaacccatttaaataagcttaatcaaaagaaaacagaaaaggaaatgtgttcaaggatacaggatgtctcacaggttccaagggcagtatagcaaaatgaacactgtccactaaaaattcatgtctacccagaacctgggaatgtgaccttatttggaaacaggggctttgcagatgtaattaaggtaaggatgaagatgagatcataccagattaaggtgggtcctaaatctaatgagaatgtccttacaagagacagaaaaagacacatgaagacacatacagaggagaaggccatagggagatggaggcagagactggagtgatgcggccacaagcccagggacgcctggagccaccaggagctgggatagacaggaaggatactcccctaggtcccctggagggagaatggccatgcagacaccttgatctcagacttttgatctctagaactaggggagagtaaatgtctttggtttaagctgctcagtttaaggtactgtgttacaggaggcctaggaaattcatacaggtaagaatgtgatggggccgggtgtggtagagtgcacctgtcatttcagcacttagggagactgagaagcaggaggatcctgtgaggtcaggagtttgggaccagcctgggcaatctagtgagaccctgtctttatactagattggtgcaaaagtaattgcggtttttgccattaaaagtaattgcaaaaaccacaccaacttaataaaaattacaaaaattagctgggcgtggaggcacacacctgtagacccagctactgaggaggctgaggtagcaggatctcttgagctcaggaattcgaggttgcagtgagctatgataatgccactgcactctagcctgggcaacagagcaagactctgtctctaaaagaaaaacaacaagaacagcaaaagaatatgatgaagatgtagaaggatgtgcagcccttctctttgtcattcattacctttctgtcttcatatctactttgtacattgtatataagcttcctccattttccactggacaaggtggaaaagcatgaccaggaaggcccctaaatttacctgttgcctgtccactcctctagagccaccatttgctgtgtgtgtggctgtgtccatggactgcagtgtcacagttgtgagccagctttccagggactgcatacccatagcccggctcagcttagatgctcaaccttggaccaagcaacgtggccacaagatgaaaatccctttgggtggatgctactttaactctcagcctggatgaccagatacctaggaggccatgcaaagctgtcctccaggcaagagcttctccaactttggcgtttggtgcaaatcaccagagaacatgttaaaacgcagttttgatacagttgatctggggtgggggctcaaagttatgcatttttaacaggcttccaggtattaataacacccatgatattagaccgaggactataatttgtttagcaaagtatcaaaactctagatctttttgtatatttgcaggaaaagaacaaggtattgcatgggtccaggtgttctttacataattttagtcatgactcttccaggaaaatattaccaggctcctaatacaccaatgctttataacagatcaaaccccactcaaaacaatcccattggtatttatacatatgttgcatctgctctgtttccacatgtatgcatacacacatgtgtgtacttgtcacatgcaaaacggtatttgcaatacattccctgtcttctcaatgaataagacctggaaaaaaccaaaataagtgttttttaaaaattccaatacagacctcgagtttgaaaagataaaagggaaccattgtcctaggaattttttgtcaacctcattttatttcacctaaaattataaaccacactgcattcaccagaggtggtctatatgcctacatacctatgtctaacaccggtcattaacaagaaagaaagctgtttgcttgagctttaataaataaaacacattgatgctgcctcttattgtcttacccccatgttaaatgtctccttttaaagtacaaaggaagaaaacaggaagagagtccatgtgcacacccacaacagagatacaatcaggcataagtcaaccatcctgggaatataaacccctctgtattgtatagatatatatagatataaatatagatatagataaatatgtatcaatatatagagataactattcatatagacagatccatatctctatagatatctatagaagatacagatacgcatatatatgtcatagatacctatagaagatacagatatctatagagatagagatacagatatacattgaaacagacatagcaatttctataaacatctatatagagataaatttatgaatttatataagcctatctatatgcctatttctaaatctctctctatatacatgcatatcaataattccaaggtcccaaacttggagaaagatttatgtatatttccatacttttaaaagtgtagtgcatgttgtcattcatcaaagcgacatagacattgtaaaagattttcattttaaaagtcttaggcaagaacagtggtacagtcgctgcagaatgtcatttaaaaatgaactctattttgggcctcttatttgggattcaatatccttggttttcttacaaaagcaatagttaatggatttctcaccgtcaatgaatgtagtgaaattttggagcctgaatcttttttaaaaatcagggccgtttaaaagtcatttaggctcatcatgcccagtgatgaaataataactggggatagaatttaaaataatcaaatggaaggccagcaaagagcataactctctactgtggatgcatgttacataattaatggtgtgttacaggtttgaaataacagaagtcagaaggacaaaggcttcaagaaaccagaaatagactcttgcccacaaagatatctttattcccattcatcagatgcaaaaatcgaattaagggtatgtacaacctttttatcggaaaatatcaatttaaagtatttccttcaagctgtattaatcttataaaatactttccctacaaaaccaatgggaataaacaagagcatctctttatctcctccatctggatttctgtaattatatttacatgtaagaaatgttatatacattcaactatttcaataaaatcttatttaagtgactgacattaattttaaatttatgataattcagcttcaactggtctggagtttacttgctatcattgaaagaaaaaggttgatttagcaactttggagtgtaaaataagacagaatgaattttgcttaaccttaagggtgcaaatatttctaaggtttacagcatattactcttatttaatctacgttgttaattaccttatattttaaaagactttaaatcctgtttgggaataacatttcttaaatgttttctaaaaaactgagtatgttgtttaccctggtttatgatttatacacatatatatttttagatattttctagtttacatatatatctatatgtaaatatctatagctatatctttttatatatctatatctatatatttccatgtgtgtatatagatagatataggtatcaaaacaagtattatataaatgttactctttgtcctatcatttctcaaatttattaaacctcatgttctgaactggcctcatataatggtgaccacctaaggcaattatcatcaacatgtttccgagatatttttctaaaatggtgtctacaatagcaaatgaaagtaagaaacaccacaaataaactaacagatgaataaaaataaagtggaacaatcgttcggatcagaaggggcattgggtaaagaattagctatgtgagggcaaagactatgtcttatttatccatcttgaatattttgcagagtttgtggaacaagcaacagttctcacattcacgcttagtgaatagtgaataaaaatagcaatcagcaaaccacttaacaatgacccaccacaaccctgctatttctgaatttaccttatctttttttttcctttcacaggcagactataattatgatttcaacttcctcatcggatccccagtcatgaatctatctaacatattcagctgaaggctgtcaaggatctactgattccacaatgcagtggtactctcccatcgcccttcactcctaaaatctctgaagaccatgacacagttgactcctgcctactccttgtggaggttaaagtccttccttgaattccataccacactttctcttaccaaagatcttctgcagatgggagaatgaccctattttaggttgttatcaagaccctacccagtgtcactttctccaaagatttgccttttctcttaagggaacactttctctattttacaccaaaatgttaagtatcatatccatagggtttgtgcttggatccgtagatcctaccttaagatccctattcaggtcaaatctcctgtcccaaagatctcaggtctgtgggtcattggtatttctatgatccaccagcacctcatttttctttccacacaagtgactctggctgagtgcactctcattcatcttagccttcccatctcaccacatgaaggctatctctagtatcttctcattttagggctccatcccatttttgctcaacttctgcaactatgcatatagtcaaatgccactcatagtgaaataaattcatcataactgtgttattttcactaatactgccctaatttatgaatgcagcagcctcgctgtactcttttgttctagaatgtcccagcccttaaatcccctcagagtaagctctctgaaaggtaatctctgctaccatccccgactaacacccataaggattccagccaatgaatattcatcaacctctgtagtccagcctgaccaatttcttcttattctcctctatgaatcataagaacctatcatcagctcaccaccactcctgttttcagggtttaatttgaggattatctaaaaaagcaacctcatgtagcagggtggccccccaaatgcaggttccaagaactcactcaagacctgctaggtttgaatcctggtgtttagctctagaggcatggattttgtaaccatcttcctgggtcatccttgtgcaccttgaacttccaaagcctttgctcacactatatctgtttctcgtctccagatattgttaacttggaataatgtcccacccctgctctccaattccccagggaaaccttgttcatctgtgaaccattttctcagcatcccaataggaagcctgttacgccttctgtatgctttggagatggcatatgtcacacattgagttgcattttaataattaaagagcttaatttatcctcttattagattttaagcaccttctatactatacatatttctctctctaataatgattagtaattaataacatagtatatattactattgcacgaacaattattatcctactgaaaatatttctgtttcacttggaccattgtattaggagagtcagtatgaatcagtagtgccccactggcttcaccagtattgcattcagagttctacgtattgatctcacaggagcttgaacataataccagaatgtggttgatggagacactgagatggaaaatcagagagaacaagtagtgtggtatagattatttctcatgttccctccagttcttgtaccaaactcagcttatatatctttcttggaaccctacagttttatttcattttatgactcccccagctcccacatttcaccatactccacaattagatttaaaatggaagcatgaagaatgatactcttatctcttccaggaattgtggatctaaacctctgtagctcctctgtctgtgttgcaatctggtggcccagttgttaaaaattggtgttttgggtcctatcctggtctcctgtaagggattttggattagggaaaatgataatttcataacatcttatattcactttttcttacaatcatgattccacctgtctaagatgctttctgacttttttctttttttgagggagggtctcattctgcaacccaggctggagtacagtggcacgatcatggctcactgcagcctcgacctctctggctcaagtgaccttcccccttcagcctcctgcactaccactcccagctagtttttaatttttttatagaaacagggtctcactatgttgccctatttttcaaattattttaaaaaactcctcaatggagtcattcagatagaagtgaaaatgtgcttgcctgctctcttcccaggtcacatatctcagggaagagatctggtacccaaccaatccacccacaagctaagccaagcattcagattttgcccaaactctccttcccaatcttactttatcatgctgccttatttagaagtgatgtctccccacatcaacttctcttcccttcactacccttcccttccttttccctccttccctttctccttttctctttctctctctgtgtctctcattcaggacttcatttgttgcatccattcttgcaacaatcttacaaatattttcttttctttccacgttggccctcttcaacttgttctccatattgccatcacagtgattgtcctaaaatataaatctgatcatttcttcccctctccctgcagaaaatatgttactggctttcccactgcctactggataaattccaccttttcagtatggcactcaaaattcttcacaattaggtctttaatcctttccttaccaccttcttttcatactcaatgtcatggcattccaaaccctccctatttctagatctccacacatacagtattgctatgatgtctttatccatggcttctttctcaacttcttgacccaatcagtgtctgtgtaccatttcttccctactcagaaagttcttcctttgcaaacccttctttaatcattttcacctccatgggtccctatgaattcatatgtattccttgtgcacaccttcttgtaatcatattttttctcatgcttttggctatcttgtccactagactgtatgctttctcaaaaataaatggatgagtttcactcacagatgcatgtcagtgcttaggactgcaccagtgctaaaaaaaaaacaaccctgaatttatgaataagtcaatgaattaatacattcttggcaaaacccatgactttctggcctactataaattactgtgttcaaggtgagattctgctttagtttaggatatagatatctatatatatgtccatatatctgcagctatatatccatatccatgtatatcactgatttggggaataagctatacttattaacaatattactatgttaatgggtcttcaatatctatacaataacggaaaaagtacatgcatatttctaaatatctatccaataattggaacacacacgtatgtatggatggatatatttttttttattattgggtatagatatctattaatagataagtgtatatttatgtacctatcttgttggtaaaaggtgcttttatacatattatttcatttagtctccacaagaaatccacaggaaaggtaattttaatctcagtttaacagattcacagaacataactgactttacaacaaggcaaagtttgtgaggatagagtcttaacatgaaaccaggtccccaaattggtgtctatcaccttccccattattggtcaggctgcccaaatatccttcacatcaccatggcaggcttcatgctttggtttactgcctaaagccgaagcaattaggaggatatcctatgtgttgcggacactatctttttccttccataaatgaattaatgggccatgaaataattttaagaaaagctaacttttctggccaagcagaagaataaaagtaatcaccatgtaatattgttgtgaagactacctggccccacacattaactcagctaatcattacagtattacacggtgattatctgttccattttacagatacagaaatggaggcaaacgattaaaatacacacctaaggtcacatgcatcttgaacccaagcaatctcattttaaaatccgtgttcattgtcacaacactctattatgccctctgatctttgcattgccaatttaaatccaactttctccaactcaactttaagtacaggggtcatacccccgtcctcgccccccgcaacttgaaactccctgggaaagataacctcctggaccctggaaatgaagaggcgtatttaaaaacaaatgcctcatcctgggcacaattccaacattttatcaaaatcatgaaagtataagaatagaagtaaacaaaaagctttcatcgatcccctctcaaccataccctgagcataaaacaggtcctgtactttacagaactgtattccaaattttgctgctcttaaaaattttttttatatcattgcttcccaaatgaattacaataacgcagacatagagactgctggagatcgtgaccttaaacagttaaagatgtttgcatatactgcagcatgtttggtgtggagggtatctagagagtcctaaaaaagcaaagaggaagaaggtttgctgtacgcgtctggtgcggtggcaccgtttgccatgcccacctgctctatctcccgagtacccgggatctctccgttacagctggtttgcattgggattagcagctctttgcatgaggttgtagctgtggatgtggtttctgtagtgatggggccgactccggagatctattggctgctggctttgtaaatttcattcagtttggtccaatggcagagggagagccccggagacagcaggacctctctcctcaatctctctttttcttgcagaaccgtctctctcccttctctgtctcttagcacagagctcttattcagccactagcttggcccttcctgcttcaattgtaatgcttgttctgcccgtccacagactattggcggcagaaacaacgaatttcctccaaactaggcggtgttggtggctcttgcattcctctggatgaggaaatctagttggggggttccagaaggggaaggctcctgggctttcaatacatcctcctgaatcatacctcgtttcgggttccctagaaaaatctggacgtgtaaaaagaactcttaacggccgatgcagctcttccaaagctaaggtaggtgcagttttaagacctgtctctgggacattattctcattttaaaaagccgtttaaacattttgacttgcagcaaaggatggaaagcctcactgcagatacttgagcttcacttcatctgatctttattttttccttttatgattattaatattatttttggaaaatttggacaggactttctcccatctgtctcgctgcatttcttaggtgtgggtgggagtgtagaccttcatacggtttttacatgcaacctctccacagaaatatttggttttattttcacttaaagagaaaaatccagaccaccgttgtttggaagcgttttgctgcaatcagctatttgaacggctctggggccgtgtgtgatgtgtttacaaagtagcgctgccttccacacaaataaacagaagactgtggcggggagaggaggaaaaaaatatatatgtatctgcagtacagggagaagaaggagagaagcggccagggctggagatggtgaaggcaggaagacttctgcaaactgtgaggcatgggaggcttttcttttctttttctctccccccccaccccccccccttattctttaagaaaactgtcagctaccaccgcctggggtgcttttttgaggggttgggggggtgctgttaaccagaaagaaaaagggaaaaccggcttggttggggtcgcatttaagcgattttttttccctccttcatctccgggcctcggataagatgacggcttgggtgatgcacgaaataacgcacgtgattgattagacctggcttggcttggctagggaacgatccaggcgcgctggagaccccgcgtgaagatgaaatgacggtagctccgggctgcttctgtaaaccggggagcgggctccatgcacccctttcccgtgtgtgtgggtttcgaggcgggtgggaagggtgagcaagccgcagaaggagggtagagctggtggttttgcttctttcggagcctttgagtgtagtctgaacctttgaggggggcgcgggggggcttgcactgccgccctgggaaccatctctgaactgcccgcttttccgaaggagcggaaaagttggaagctgcgaggacagactaccggagccctggtctgggtctcgggggatctggagccctagtcggtgcccactgagaacaccccttctcggagcgagggtgtcggggggagtgttaagcctgcggggcgcacggtccgccagtccccgaggtggggacgggggaggaggctgaggagtcggttccaataggcgcaccacctctacagccctggaaaacgcaaccgccaccccctcttcccttccatcccatcccaagcctctctgctgtcccgggccgatttcatctcgtctcttcccccgcctccccgcttccccgcctcccaattcccgcgcggctcggctcagccccttcccactccagtgggcagaactgatggagaagatccgccaagcgcgcagccggcggcggaggagacagtgcggggtgggcgaggggcttcgagaccacgcagagagagagtgaacttcagtcctgacccctccccaaggccgcggctggggcgcccacagcccgcgctggcacccgcgtggcctgacctgcggaagcgcgagcggggatgaggtagggagagggaggtaggtgccgctcggctgcagatgatgcgtgggtggggggcttgctgtgggaggagaggcccaggtcccggcctgcgccctccaccccgcggctgctccctccgcctctggttttccaagaggccggtcgctaccccggaggacactctcatccttcagtcagtctcctggacaccccttcctcctcctgtccctcaacctgacctggctctttcgcccctccgagaaccggtaggctggggtccctcggcggggttctcctgggccgcacccgaagctttgcgcccccggtatccgggcccagtgctccgtgcaaccctgggcccgagcgcacgattccggcgcctgctcgccgccagacacagcgccctttcttcccggagcggcgggggcgggagcaggggggtcaggccaacccttgcacccccgaggcctgggcccgggccaccctgggaacggatgttctgcatggagagcgaggggcagccggaggacgtcctccgcatcatacccctccccttccccagaaggctttttttttttccggactgcgggtttctttttctctgccttcttcctctgaacctacggcaggtgtcagcctctttttgtgtatgtgctgctgctatctcggggatggcgggggagggggtgcaggaggcagcgtgaaggggtcctaggaggttccggcggggttttggcccctgcggtgcgccggggcttgcaactcgcccgggtgctgggcgcgcgcgtcacgaattcagcctagggcttgggcgagtctgcggggagtgaggacagaggatcccgatctgtcatttggacccaacttaagaaatttggggtgggggttgggtgggggttttggaactaagcaggtgatgttcttgcgagctggatccacaaggtggtagtatggcttctttttatttttattttattttatttctatttggtcattttttttggggggggcggtggtttgttgttgttgttgttgctcttatcttatgctttttgaaggcatccgttgcccgtagggtttacatcggagcgcgttgcattatattttcttgaaagggggtggtgtgcgtgagctcccatctcagaatcagcccttccggtgatgtgaggaaggcaaaagcaaaaaaaaaaaaaaaaaaaaaaaaaaaaaaaagaaaaaaagaaagaaaaaaaaggaaaagaaaaagtttagggagacctcgttatcctgacgaagcagaattgccagtttgtgtgggcgttctgcgggcaacatagaagtgcatgcttaagaaatccggggtagcttccttctccagctagaaattaaatggccagggtgcaaacacctgactttgatgagaacaaagcggcagaaactgcaagagacctgcatggtttgaatggacgcactgagccttttcctaggggatggcagagcggggtgaaatcagatagcaaagaaatctgccgttttgtgggggcagatttggagagtggagaattatttcatacctttagttggctgtggggaagatgttagcagtaatccattaaatcctcagcatagattttcctgtggaaatgagcaaaatgttaagtgggggagggatggctaatggcacatggttgcattaatccctgtatttccagaaaaaaatatggaatttctgtgtatcctaaaattaagaatacaggaatttcatggagaactctgcaagcatgtattttctcagattagaaattcagtattttattactcaatgaaatgtagaatgcgtgtgtgtgtatgtgtgtatacagacatacacacacgcattctacatttctacatatatgtgtgtgtgtgtgtatatatatatatatatatatatatatatatatatggccattttaaagagtattttctttgacatgtaagaacataatcagggccagttgtagcaagtggaaaattacttcatcagttttaagtcagtagattaaaatggaaggcttcatttttttttgaaatcagaataataattgcattttcataataatgcctgtgcgtggatgcagttttaaagatgctttgatgttttcttctccagtggaagaattgctacttttctttgcgttttatttaaataaactaatgccgagtatacagttggccctcaaaccagtaacctagctgatttttacccaaacctgagaatgtaacagatacttgataagggactggtggctgcataaggtagataatgaagttatcttgatgctgtgaaatttacaagcagacttgaaagaatttgaaagttcatagttgttggcctggaatgtagcctaatggtaaatatatagattttttaaaatttgtgaacttggctatttcattgttttgtgtgtagtaatttgtggaaagcttatagtctctccacaaagatgagagtgttgactgactccgcaacagagacttgcttttggaagtgcaggggtctctttaaaagccatttggaatactgtgcttttatttctagaccacaaccaaaaggttctcaaaaaactaaacattcaagtgcacgagggaatgacctccgtttaacattctttctttttaattggtacgccacatttcaaaccttttgtaatactgttgaatattgccaataatgcaacttgttgagcgaatgattgcattcaaatgaagtagcaatatacaaatattttaagtcctttagtatcctccttctaaagataggcttatctggttaaaatatacttatattccaaataaggtgagagttggtcttaagatgtgaatgtcaagtgtaagagacacgattttagtttgtaaaccagaatgtattctttctgtactgctttctgccttttaacaatatgtattctattcccaaatggggaaatatgttcagtttagtttaaatctgttgctctttttgtgtgtgtttttgtctgagtactgtactttttcagaggagagacttcgtctcctatttaattatgtgaatggatattcagacagatttgaatagccaccactgatttcttaaactcctgagctaccagttttaaatcaaagatacatcttttgcacagtcaattagaggaagtgagaatcaaaattgaagcccaggctgctgaggcaattaggtcatctgctgtgctctctactaccattcactcaacgaatattttccagttctgtcatttttctctaaacaacctacatttggactttgaaaggctccactgttctttgttaagtgaacggcagtgtaggaagcccttcctcatttttcttggagcacagtagcacacatgaacaagaaaaaaaagaaggtgatagctcctagcagtttgtcattgtgccatttataggctttgaataaatgtatagatgaaaaggctttccctctgcaggtggttacattaaacaaaaaataagtaaataaaagcctcataaaatcattacgggagtggaaggttggtggtggaaaacagcccatctacctcgggctgagatttcaaactttagacatctcgtgttcagttcacgtgtcccaggtgtgtgcggaacacctccatacaccacatcttcccaaggcactctcatcttcccagaaatggtacctgaaggagaacagacctaaccccaacaatactaaaatacgtatataaaaaactatatatagtaagatatgtatcctactatataatatatatatggtaatacatattatagtaaggtctgcatcatgtatataaaaatacactatatatcttattattatatatatagtgagatgaggtgtattaatccattctcaggctgctaaaaaagacatacccaagactgggtaatttgtaaaggaaagaggtttaaatgactcacagttcagcatggctggagaggcctcaggaaacttacaatcatggtggaaggggaagcaaatacttccttcttcacatgatggcaggaaggagaggaatgagaaccgagtgaagggggaaaccccttataaaatcaacagatcttgtgagaacttactcactatcataagaatagcatggggcaaactgcccccatgattcaattacttcccaccacatccctccacgacacgtggggattatgggagctacaatccaagatgaggtttggtggggacaaagccaaaccatatcatgaggttttattgaatttatttgagacaggaaaagagtaatcctccataatttagaaaggagatgaagtacaatgaacatttaggtcctcattagttgaggaatacatttcaaagagagaaatgttaatttcagtatagtgctaatgaaacgatctaggctttcactgctctctggaaatgtggataaatggcccagaattttgtttgggttgttttatttaaaatgtatattatataaagaaatcatggtttgtcaaagtaacagagtgctatttttggcttacaacaggactttcttagctccacctgttaatatcggtgatcattttggttttaagaggctggtacctgattggatgatgaaaacttggatctcaaagccatcaccccagacatgtgattttattaacatctgtgggcatctgtccggctcccacatcaacccttcatccaggctcattttctgtttgtttttgtttggttgtttgtatgctttggttggggagaggggacacggattttgctaagggcacctttttcaggagtgaaacttagcctgtcatataagctgaaaaggaacttgggttgtttcaagttgcattacttggtaagtttttggatcctttaaaaaagaaaggactgaggttactaaaagtgttattggcactgataaaagagctatggtgaattgtggtttgtttttgtaaagtgcagaaaaggcctctttggttctgtgatgatggctgtggtgaagttgcatgcggtgccattttccatgtttagtatttcaacaccaccaatatgtggctctggagtatgggacgggcaagtccaagaactcagtgaggcatgccgtgtgactccaatggtcagagctgttcagcatggaactgtggtctcaaaagcatgggggatgggggcagaagaagctcgctgcaactgagtgcctttaacttattccactcttcagtactctctgtgactataactctgtgaatgggttaggtggggaaactcacaaaagtaaatgcatgttttcacaaacaaaatatgtcattgttaactgttttcctaagtgagacaatatgccctcatgccctgaagctacatggtaagaatggcagtgtgtatgagcgggtgtatacacatacatgtatgcatatgctaacacattaactaggaactagtctttgctgaaaatgtttttctcagccattgcaacacattagataaaagcaaatatatatatatatatatatatatatatatatatatataatataagaaggaaaatgtggttttccattattttctttttctaatcctcatcattcaattctcagagggtaattatatagttcgattttaacttcttcaacagaccgactactacagttgatgagcaaggagatgaaagtatttgataaacatcatggagttaatatgattcttgagggaggggagaaggctgcttgtcttaggtaatgcttttgagggtaggtttgtcctagccttgaggtagcaggcttgctctgttggctgaagaagccttaacatgcatgcccgtattgcaaatttacccacatgccaactgtatgctgtgggaagaaatgaataatgtagatgccattacagggaattaggcggaacggatagacttagtgcatcagaaccaatgagaagtagacaagacatttagaaaatagcaacagcaatgaaaacaaatataagtaaaccacaatcaaaacccttacatttgggtttctagttgcctgttaccacagagggttctggttactagctaaaatgtaacccagtaggaaggtcaagacaaggcccctcatgctgtctcaaacagtaacaaacagtaaggatgacccagggagaaagggtaacaagttacatggaagttaaataccagttacctgtgcagagactgaaaacataaagcagacacaggaatggcagtagtagaaagtggggaaaatctgaatttgttgcagcataaaaccaaccaaccaaccctagtgagggaatcaatacctcaaaaaaaaaatcttctgacaatctaggttcatggtagagattaaacggtaccatattatgaggacagaacaataaatcacacatggcttcccatagaatttgtgtgacagtggttgtgtactatgattcagtctgtcatgacaatttcaccagtaaaataaccttccaggatttatttgatatctcaattgataagcctcccgtaagtgaataaccagaatatgacataatttataaaaattaacttaaaattacacaagaagttatgtgtctagtcatttcacaatcaaatgtatttaggcatttaatctagtaagatcccaaataataaaaaattgtttctttctagaccaacatgtatcctgatgttataaatacatatgtaaattatatacatatatttgtatatgtaaaatacacatacatttacatatgcatacatagctcactttttattggggagcacatcttcctgaaggtttttcaaagaataattattctacctgtaatgctgtagcagtatttgtaaaaagttcaaatgtggctgggtacagtggctcatgcctgtaattccagcattttgagaggccaaggaaggagggttacttgagcccaggactttgagaccagtctaggaaacaccatccatacgaaaaaaatttaaaaataagtcaggtgtggtggtgcatgtctgtagtccctgttactcaggaggctgaggtgtaaggctcacttgaggagtatatcaggagtttgaggctgcagtgagctatgacctcactactgcattgcagcctgggcaacagagtgacactccatctcttaaaaagaattcaaatgcctcatttatctggacagaatttgattggtgttattctattgctgaataattccagggtatgcatttaccttttctctattgactttaaacatagcttatgaaaaacaaacaaacaaaaaccaaacagaggagtttgcaaaactatatttaaaagtaaaccatactccctcacccctgactccacaaaaatactgtttaatgtagagaaaccacagacggtgcagcccccaaatctggagcatcctcaggtacctgggggcattctggagtgaggggctgagcctcagaggcatttggtcacacttgggtggggatgcctcattggctagtgaagaagcagctgtctcttccatgtagtggtcagttgtggcctctcctggaagggaatttatccagcagtgtgtgttcctgaagatgctaatagcaaattatgttcagtgaagccagctgcatcctgttggtcttgctagtcccgggattcttgccacagcaggtcagaatggaagggagctgcttatctttcctccttacttcctctccccatcccagctctcatctgacatccttccaacacctatatgacaggaaaaaaattctctcttcaaattaagaaaagggtctggtctgggtacgatggctcatgcctgtaatcccagcactttgggaggacgaggtgggtggatcatatgaggtcaggagttcaagtagtgaaaccccatctctactaaaaatacaaaaattagccaggtgtggtggcacgtgcctgtagtcccagctactcaggaggctgaggcaggagaatggcttgaactcaggagtcggaggttgcagtaagctgatatcacgccactgcactccagcctgggcgacagagcaagactctctctcaaaaaaaaaaaaaaaagtgtttgagtatttactctccacatctttcagctatttcacttcactgggagtagacaggacaggatggctccagggacagtgctattgttaccttgttatccacttccaatttggaaaggtaaaaatatgcttcagtgtctactaaattgcctgcattgaatttgaagtacagtttgttgggatactcatgatgaaattggaaaacagaatcacagattgttaggacttgaatgtacttgagcaatcatttgtattccctcatgtacacaaggaaattgagtcacagagagtttcagtgatttatcctcatcctttttttttttttttgagacggagtttcgctttcgttacccacgctggagtgcaatggcgcagtctcggctcaccgcaacctctgcctcccaggttcaagtgtttctcctgcctcagtctcccaagtagctgggattacaggcacacaccaccactgctggctaattttgtatttttagtagagacagggtttctccatgttggtcagctggtctcgaactcccgacctcaggtgatccacctgccttggcctctcaaagtgctgggattacaggcgtgagccaccatgcccggccgtgatttatctccataattttaaacactatccctgcaatgaaaaaggaatacccccaatttttaacatatctgcttacgccagttcatgacaagcttacaaaattagaagtaattttaaatgggcaaaataaagcaaagtgcattatttaattttcaaaacagacttttctttattatgcagcagcgatttaaacagataaatcatttctatgaaagggactagcagagaaagcaggaaaagacatgtcccacattaaaagctgaacttgttggtgggaactcattttgttttatgagttatgatgaatgcaccttagctgtttctaaccccgctcccattccctgtttttatttgtaagtcagaacccagcatttttacattttttgaagtgttaattaattgcctttgtttaatgcaccttgctgtgtctcaagcattgttaagaaaggataagatctttttcagggatgattctttcctttccttacagggctttgtctgtgatgagaactttctatacacatatttttctttttaagagacggggtctcactatgttgcgcaggctggtctcgaacgcctgggctcaagggatccttcggactgacctcctgaaatactgggattactggtgcgagccaccgcacttggctctatctttctgcaaaaactggtggattctacttctctctccatctatgtttagtcctgggagatataatcaagagaaaagaaacatctaccttcattagattaagagtcaaacaaaagggcctagaggcaaagaggctccacgaccctcttttgcgggtgagcctgtgcattgaaatcctcagcttcaaagagacacagaaggcaaaataggaagttggatttgcaggagttagtctcttggagggtcttgtaaaattgaagggttcacatatgccctgtcaactctccaagagagagatgacttggtgaaatctgtattttgtgatgattagtctttctcagagggctggttcaagggcaaacgaagggcagaataaggacttgcagatgtgttaagaacagaacccgctgtgttgtgcgtcaacgacaaaagcccactccactcctgacattcatattttggggtaactgttttttgcagtgcagacctgtgaaacctggagtattttcagtcacagcttttatcgagatgctttctgttgacctgagaattaattatggtttgtcaaacagcttgacgaccttgtcagtggtgttttttggtttttacaactccccatctaaggatttgagaatgccgcagtggataaaactgtgtgactgacgttcattatttttttccacaatgctttaaagtaagtgcgctgggaatgctccatttattatgtagaggagagacatttccaaactttaactttgttgctgttgcttttgtacactgaggcattgattctgcaggattaaaagaaggtgctgattattccatttggtggaaagtttcaggagtggaagccagcagaattgttccactgagatgataattctgactctttgattcttacacattgactacttttacaaaatacaaacctgttttaatctttttaaaggacatttgtgcgctactgttttcattttttaaaataaccttttaaaaattttaggatagtttcaggtttgctgaaaggttgcaaagatagtacagagagttactctttaactccacacgcatatcgcatcttacgtgaccatctgttacacttaaggaaccaacattagtacgttactaagaactgacatcacaatttgtttggatttcactggtgtccacctaatgtcctttttctcttctgaggtaccatctgaaataccacactgcatggatttgccctattttcttagcctcatctagtctgtgacagtttctcagtttttccttgtttttcatgaccttaatagttttgaggtattaatgtcatggagaatgtccaccaactagagccagtctgatgttttagacaggggtatgtgtttgggggaggaaatccacagagatgaaggtttccttcatctcaccctagcaacggtgactactgtccagaagacttttgctgctggtgttggctttgatcacctggctgacagagagtttgtcacttttctctgctgtaaagttgtactctcccctccctgcccaagtctagtctttgaaaccaagtccctaaagtggggtgggggtgggagaagaggcagaattaagctccactttccggatggtggaatatcgataaattatttggaattcttctctaagaaagatgggtctctcccctttatttacttaatcaatcatttatatcagtatggacacatggatattttagatatgctttgggctacattgctgtgacttattccactttatattccttgtggccatgatgtagacaccagagagtctattcacttgaatagcaagtaaatgaggggactcaatggtaaatgactcttagagaaactctcagccctgctggttcatggatgctcagcttgcaaaaacaccttcttccatcaggaaacctcagtggatgggcaaacattacagcgtccttgaatatgcttcattgctttaatctacgaacttcctatgcagtaagcaaaaccacccataccacagcttaagagtggggctttcctcccaacactcatcctagtgtcttttgataaagaggtataaagttgaaggaacatgttactaaccagaagacttccagaggaccccattgatcagggtagatgaatggctgtgtgcgtcttgtcacaaccatcagtatttcaaaaggtgatatcatcctcttaaccttatgatgtgttttaacataaaattttaatatgcatacaggcggttattacttaagcattgcttaagaagcagtcttttttttttaattcatgtaactggatctattctctgaataaggaatataagcaaatcgtagccatttcaaggactctttttttttttttttaaatggagtcttgctctgtcgcccaggctggagtgcagtggcgcgaccttggctcactgcaacctccacctcctggttcaagccattctcctgtctcagcctcccaagtagctgggattacaggtgcccacgagcacaccaggctgatttttgtgtttttagtagagatggtgtttcaccatgttagccaggctggtctcgaactcctgacctcagatgagccgcccacctcaacctcctgacgtgctgggattacagacatgagccactgtgcccagcctcaaggaggcttttaagggcaggatgtttttttttcttatggtgaaggaatgaagagtagtatgggaaagaaatacagaaactttgaaaaaagaaatgtaaaactggatcatcattccataggctagtagttaatagtaaataactgtatagtttgttcaagggattttgtgaatattttaaacacagatgataattctctatctacatctacgtgtttacctgcatttatatcatatgtacgtatggacatatatatttgcctgtagatcacatctttgtatggtatctgtaccaatattagagtctatagctacagcatatcaataacagtatctattcttatctatatcttaatcatatctatttttgtatctgtacacatatctttaccgatattcacattatatttctatgtctagatctatatatatctctatctataccattttgaactttacatttcctacagtatgatagcataagctattttaggattattaaaaatcttcataagcattgtttttcatggttaattttctcaaaagactatgctttaacatacccagttctttatatattttttgacatttggcttattttaatgtttttgctcctctaatgtatttttctttttttactccacacccctcccgcctctaattttcaaattgggcattcttcattataggggcattgcttattttcttttgtatgtttcaaaaaacattctgcattggtctgtacacatttttccctcttgtatcccttctgtaaacatttgtattcacttgaaaccttatggaatattttactacagaaaatttctggttatgataaaaaaaggcagagaagatagaataaaggatcccatgtgcccatcagttggcttcagcaattatgaatggatagcctaatctttagtatctaacttcattcatatttccattcttattatggcatgatgtaattcatttaaagatatgtctgtacgttgctctaaaatataggaaccattttattttacacagctgcagaatcttttccatgcctaaaattatcaacagtagttcctctgtatcatccactataaagttgtaactgtcaaaatgatcttctcgtagttttgtaactcacgcaaggtcaaggtctagcactgcaataggttgatttgtcttttacatttcttttaattgatatagcttccctatctttttatgcacattcttgttgaaaaaactgctctttttactctacatgaaagtgggttttagaattggaaaatgtagttgtcaagttattttagaaggaacgtgtgtattttccgtaatgcacagtcttaagttactaactccttaggagcaaacgctgtgtgacttggtagtgttctacccagaaggaatgctgctgggtaaatttggccagctacgtgacagctctttggactcagtatatctcagttttatctatttttaacaaggttttattttgaagacagggtctcgctctgtcgcccatgctggagtgcagtgatgcaatcatagctcgatgcggtcttgaacttctgggctcaagcaatcttcccacctcagcctcatattatctagtacctggcagagatacagatctgatgagaagcaaagatagaggggtgtcagaaggtagcttttgttgcaccattacatacatacacacacacacacacacacacacacacacacaaacgggcgcacacgcacgcacaaagaatcaactgcaattttttcctctttgccaacccacagttaagtaaaattattagttctattgaactccacattgcatgtgatattttgaatgatagaggctaaagagaggccaaagagggaggattgcttgaggccaggagttcaagacgagcttcgacaacataatgagaccgcgtttctacagaaaaaaagaaaaaaaatagccagatgtgatggctcgctcctgtaatcccagctactggagaggctgagacaggaggatggcttgagccgaggagttggaggctgcagtgaactctgatagtgccactgcactccagcctgggtgacagagagattctgtctctaaaaaacaggaaaaatatgactaaagaaaaccaaactaatctaatctatacagttatagatagttggctatcattcttatgctaatgtaagtatgcctcattttaagaagagttgtgtgtgtgtatgtgtgtgtatctgtgagtgtgtgtgtatgcatgatataaatccagacttctaagcgagtatcagggatggtgaactattattagtagatcattggaacctgttacacaaggatgcactagagaattttacaaactattaaattctgtataatttaaaatgtgacttgatttactcagatattttaaaaggatgcatgtctcttacaaaacaagatttactaactttggtgctcttgacgttgaggctggataattctttgttgtggtggctgtcctgtgccttgcgtgatgctgaatggtattgctggactcaagcttctaggtgcccgttgtatacacgttcctgttttaaaaaaaacttatataaatttaacgggcacaagtgctgttttgttacatggatatattgcatagtgatgaaatctgggtttttagtgtaaccaccacccaaataacatacattgtatccattaagtaatttctcattcctcatcatcctaccaccctcccacctttttgattctccagggtctattattccactctctgtgtccatgtgtacacattatttagctcccacttaggagtgaggacatgtggtttttgactttctgtttccgagttgtttcacttaaggtaatggcctccagttccatccatgctcctgcaaaagagatagtttcgttctttttatggctgaataatatttcgttattcatatataccacattttctttattcatttatccattgatggatgcctagctggattccatatctttgctattgtgaatagtgcggtattaaacgtatgcgtgcaggtatccttttgacatagcgatttctttttatttgcgtagatacccagtagtgggattgctagataagatggtagttctatttttagttctttgaggactctccatactgttttccatagaacttatactaatttacattcccatcaacagtgtatgtggattcccttctctctgcatcctcatcaacctctgttatgttttgagtttgacatccacaatgtctgcagacagtctcagatatccccttgggagtaaaatccatcccagttaaaaagctctgttatgaaatgaggtgtacttattccaagttttacatggggaatttcactggtttttgggttctagtagccccgacgtgtatactgggcatgaccagataagataaactgggcaaagagtgcaatgagagatagtaaccacattattttggaagatgtttttcataaccagaatagactttatgaattctatcaattgtaatgagaatcggattgacatttggggacagttaatataacgcacgttatccgaaaggaggtggcattgatttatataagtgagagcttacgagaaaacaaagactggaaataaagaaaaagaaaatccttgataagtatctgatagaacaaagtgcagaacgaaatgcagctagcttatctaaaattgggcaaaatcatgttccaaatgaaagctcagtagatgggaagagagtatttgaacatttgatgtgaaaaatgagatttactgttccacagatatgaacacattgatgagagctgtcagttattagaacttattaacatcaatgggaacaccagaaatgtgctgcacagaaaattaaatttaagactgtttgaaaatggtgttatattttctgaactgttacattgattgattaaaattagattatccaacaaaataagaacttttgatattctgtgagtgaatatgagatgaatttatgtggcagatgtgtttttaaaagatgtattattaaccgcagagattcagaattaatgtcgccaaccccaaagaatgcagtataacatttgtcataagtgacctcataataggttattttataatatcgtttttaattttgataataaatggacaccttttacatctttaataataaaaggatatatgcaaaaccagttatttttattccaatgttaataaaatagcaataagcctcatttcatttgaagcaccaactttcactccatatcaaatttctaaaagtctgggagatactcaccaactagtcaagaagattttcattctataaaattgtataatgcagtgaatcctgttcttttcccatatgcatttatttaatatttatatttgatacaaggaatctatattattttcattaagccactcataaacgtaagtgttttacttcttcttgggtacatttttaaaaatttggttacatttttgagatgttgatgccatggttaaaatattccaactaagtaatgggatgggtttacaataagtttttgctctacaaggaaataggtcaataaatcaggctccagccaattataggagaaaaggaaaagttaacttattatacattattgcacacagtgtttgatgtatgtatgcaaattgctcccaaatacagtttggttgcagttgtgctccacatttatggtggatgcagttttgaatatgtgcagagagaatatattctgacctcattcatcaatgtgatgcaaatgtgtagaaatggcaaggtcatttttgtatgatgataaaatgcctgtttgaaagtaaactcatccacccatccatccaaaggttgcattttctcaattcccaattctaaatatgtctgtgtgtgtgtgtgtgtatgtgtgtgtgagagagagagagagagaatctagtgcaattttattgttctactttgttccaggcttgacattttagtgattgaaactaaaataccttgattcttaccctctaattttacaaataaaatctggtttactgttatggattgaactgtgttacagattgaattgtgttccccaaaaagatatattgaaatcctaatgcccagcacctcagaatgtgatcttattttgaaataaggtctttgcagatgtaattacaatgaggtgattaaggtggcccttattccgtacaactggtgtcgtaaccaccatgtgaagacacagacactcacagggtgaagacggccatctgatgatggaaggttggcatgatgcagctacaaaaagggaatgccaaggattactggcaactccctgaatttagaagagacaggaaagtatcctcaccaagaaccctcagagggagcatggccaacatcatgattttggacttctagacttcagaactttgagagagtatattcctgtttcctgagacataagccttgtgattctttttgatagtaactctaggaaactcatacaccaagacacagagttatttatttaaattcattttttttcatttaaaaatacttatttgacaaagactgtaatatggaaagtgtccagtgtgatgactggatgtacgtatacattgtgtaacaatgatcacaatcaaattaatgaacatatcactcatagcccatgtggtacataatggatggacctgaagttatgcagccagcttggggcagagctgggtttgaagggcagactcctcacccagccacacttgtcttccagaatcactttcacatcgtcatgaggattttagagactccactgctccatgtcactgcatcaacacattgtggagtggggggtctcataattcattgcaggtgtctgaagatcaacagttgggtttcccttccctcaactgtaaaatgagtgagttggacctgtctccagggcctttctaagctatatgatttgagaacaatgatcattgtaattaagacgcttgacttgaatactgctcattttaaaccatgattagggatatgagatgctccgtgtgttttctaaataaacttcattgtgacctggttaagtgttggatatgaattggcaagaggaggcttgctagtagaaatggtgtaatttaaaacccattcacaagtatttacacactgcaagacatctagatcctcagaagtcaggtagtatcctaaaagcacagtgtgtaatttatggtagataattgaaattgcactgaaattgaacttggtggtggggagtacacttcatagtattcaatttttgccttcactttattctatgtctgactctcaggaaataggaactgcaacgttgggtttctccagtgtattttcaacttcaaacttgtgaattgtaaaccattaaacaaatgatcaaacactacatctttccctgctcttgtatggacatagagttttgttattcatgccttctcttttcttatctgggaagagatctttcttaacctttagaaattggattaatgcgaccctctttaacctcacatttgatgtgaatgtcagaactttttgaaacttagctgtgcttttagtacactgatcactgagtgcccgttgactggcaggcactgggctgctcagtgaggtaggtgaagaagagacaccagctccctcctggagtgtgtgctctgctggaggataaagacacttatcaagcaatagcataaatgcttctgacaccatgactctaatcagagtggcacagccaatgggcatggggctaggagaatatgagaattcgtaggtatggggatgctgtcagggttcatgaaaggtcttcccaatgatgagaaaactgcaagttgggaggaggtagaaataactgaaagaaatggttgtagagatgaatacattgggggatgatcgtgttgcagggtgacatcttttagtgataaaagggatagagtttgagctcctgctgcagaccctcagcgatgtgttgtaatggtaagaattggctcatggtttcctggtttgcctgattgctgcatccacaaaaccatgggttctggggttaattcccatccattttgttgctgaatttctcagaatgatagtcttcggtacattgttactgaaaggaggtgctaaacccaatgtcttcattgcttttgaagcagatggtccagtgtagtgtttctcaaacataagcatcagagtgtcctagaggtcttgttaaaggcaaattgctgggatccatcccaggagtttctgagtcagcagatctgagatgggacccataattccccagttgaagttgccgttactggtcttgggatcactcttttagaactactgccttagggtatttctgggttacatgtgcacacatgacctgcttaagttttgagctcaacattctgttttattccttcctgttcagaggccggcatccacagctctgggtctcatcatttgctttttgtcatccagttgtgctctactgatttataagttatctttatgttttcagtttcccagtcaattcaagccaatgcatatttattgggcatctaccatgtgctatggactgtgagggacttaaagattaataacaacaaccataaaaactcattgacgtgctgggcattatttatttccccatggcccccaaatgctaggcttatcattcaaaacactacagcaacttgaaggcagcagattgtttctcatttcagggatccacaggtatatggcttctcaaacgaaggtctggtaattccaggctgcatgcagctattcttcctttaaagactgagaaaccatgcatacaacatcttttcttccttcttcgtttatacatttgataactatgtactgacatcttactttgagaaggtcaccatgccagataccgtcagtgatagaaacacagataagattcaacctctgatcccagggagactctcagtaaggaagagaaaatgagaaatgaaagtacctatactacaaggcatgcacgtcacacattccataagtgggtaaaaacacagaccttggcagcacagaatcttgttttccatttgtgtcatttaggacactgcattggttatctattgctgcataaaaaattcttctaaaccttaggttaaaactgcaaacatttatcatctcatgcatttctatacatcagggatttaggagcagtgtagctggccagttctagctcagggtccgtcatgatgttgtggtcaagttgtagacagggcttgcagttttatgacggtgttggagaatctcacttatgtgtcacttggcaggaggcttcagttcttggccacatgggcttctccctagggctagacgtgtgacattaacagctggcttttctgaaagtgaggagagaaagagggaggctgaaagagagtctaaggtgaaagccacacactcttagaacttgatcttggaggtgacaccttgtcacttttgcacttgatttggaggtgacaccttgtcacttttgctacatgctattggttgttcaaatcaaatctggcaccatgtggatgaggattccaggaaggtgttaattgcaggtgtcagttggccatctcagaagctagactatcaccagaagctcttccaaaggaggtggcttatgagctgcatagaattttgtcataaggacaaaggagaaagtgtgaacaaacacataggtacagcaagtgttgaggaatgggctgtgttgtgttgagtgttgtctcaagggcatgttgagtttgggtgatgaaattgaaatcagatcatttcaggtggtgcaacttgatggtaagccatatagatgttattctgtaggcaatggggcaatcatattaggacttttgcagaattatttaaggaatagcagtttcatgatagtagaggtagggatagaagacagaaggtcagtaatgcaagttgagatctagttatagattcaactgtggtagagattgaggaaatggggatggcatgaggctctgcagaggcattggaaggatgatactgatagaatcttgcaaactattggatagaggccaagacaatgaataaccatccaaggttgcagttatgggtggagttgtccagttaagaaaagggagagagttcagaggtaggtgaaggtcagcattattagatgctttggagacacatgagactgacagagatgtttactattttttttggtgattataaggtaatcaatagactttgagagattactgtttttcagtcttccatattatgttgcttggatgcatttttcttttttcctgaaacttggcagacatatccattatcaagacgttttcagaggggcatggtggctcatgcctgtaaatccagcactttgggaggctgaagcaggattgcttgagctcaggagttggagaccagccggggcaacatggtgaaactccatctctacacaaagtacaaaaattagtcaggcatggcagcatatgcctgtagtcctacctactcgggaggctgaggttggaggattgcttgagcctgggaggcggaggctgcagtgagcccagatcacactactgcactccatcttgggtgacacagtgagaccctgtctcaaaaaaaaaaaaaaaaagaaaatgaaaagaccttttcaaccattctaatcataattccaagacctatttgtgtcctgacttcaagagcaggtactcttattgagaaacatttctgtaattgttcccacttcccttatacctttttttctgacagcaggtggcatcccctcagttgtctagctgaccactggaagggctgacccctcaacaaacccatatcctgcttggagtttctctataggccctgtcttatttattgctcctgctttgagtaactttctccttcctcaaatctattcttctaattttccttcactgcctattaattgaactgacttttctgattgtctgttcctcctgcctttgcagttactgtcgctccctaaattccatcctcgaatcactcctcttccttccgtactgtcctatgtagctttgcatctactcatggtttgatgattatttccatcggagagaccacaggggtctctatcttctgctctcacttctcttccaagttccttcctgcccttacagctcccctttcaacaacattgcctatatgctctggccaaaactcaattcagtgttcccaaaattgtcccatcatctttcttgccaagcttaccctgctccctgctcatggcatcttctcctctcaattcctcatcttggatttgaatcccctctctttcccatccccagtgtaaatcactttcagaaataacaggtcctgtcatttcttcttctgagatacatctgtactttccttggtcatcttctcactttatgtgttactattttaatcatatcctgtctatgacttgtacactctccaatctatttttaaagctattctttcttcatcttcacaaataattgattatgtaagactactatctcgttcaaaattcataaacaagcatccactgtgcttcaccacctgccccatctccgccgttacaactgcagtcatcattttactcctctgggtgttatacttcatcctccacccaacctgagtatggataggaatcactgcatttcaccttggtttcttgctttttctcattcttctcaggctctctttcaacctggaatactgttattttcccatctccacaccttattcatgactgagggctaaaatgctgtttctttcactgctctctctaacatgcattgtttgtattcctctgtggtagtcatcaatttccattacagaggccaggagacctgatactttcttgagtgtgaatttcagtagttgacgtcttgtgtctcagtttcctcagctgttgagggctgtgagaagagtacctacctcgagggatgtttgcaaaataaataagttaaggtcaggcactgtggctcatgcctgtaatccaagcactttgggaggctgaggcaggaggactgcttgatcccaggagttcgagaccagcctgggcaacatagggagaccctgtctgtacaaagaataataataataataataaaaattaggcaggtatgatggcacatgcctgtgatcccagctacttgggaagctgagacaggaggattgcttgagcctgggtattcaaggttataatgagctaggattgcaccattgcactccagcgtgtgtgacagagcaagatcttgtaaaaaaaaaaaaaaaaaaaagaaaaggaaaggaataaattaagcatataaagcactttaaaacaggtatttagaaagtgttgaaggcggccttgacattacttatctttggcccatccttgtctttctccttcgtagtctaaaatgttttacaaaggactgtttctcatgacactgagaatgaaccccaaattcctttcactgacctattccacttttatacagtaagcctcttgctcacttctccaccttcatcccaggccatcctcttctcactgaactgctgtcccagtcctcttttggttttgtgatctgagtggataccgtgttaggacatttttgtgtgccactccctctgcccagagcaccctgtcctgttcccatttaaagtgggttccaccctcgattgtgttcttatttaacccattatttactttcttctctgagctcacctgatctcaaaggcttttttattctttgtctacttatggatatgtgtggaggatctggggggttagtgaatttttctctgcattctctaaacatgtgtattgcatgaatctggaatagatcagcccttactgggtatttattaaagaaatgagtagttgtaagacactctatagatattcatttaatgaatgagaaaatcaaatgttgcctggtaaaaacaagtgttaagtcagctatcacagttttctgagatatgcagccaagccagggagactgagggaaggatgtctttcattgtaaaatcaacgcactgtaggggaaagttcctctctcacctaagggaatatcgatcttccttgattgtttgctttggtatttctaaattagcatgatttaccaaaaatgtttggatcactcagtacatgcatgtgattttttctaaatggctatctttaaaaaaacttcctcatctgtattaatgtccctagagtttttacattttttgcctgtatttcattaaagatgatgtcatagaaaatttttgtcaaatttctcattctggtccgtgcctggaagattgacagtgatgcagtctaagaaagttcaggattttgaggtttaatcatttacattctaacactaaagctacaaatctgccgtgcagtgttgcttacttctactgctcactggatggatgagtctatgtgctttttaaattccttataaagatgtgggtcaaaactagcagtgtggtcaataaattaatttcttgagagtttatcagaattgtgggatgatttgggaggagcaaaattgtgtaaaatcaatcctctatttttaaacttattcttctaaaattctaaatagaatttttttattcattaatattttcttgatttcataatgctaaaaattaagtaagatgaatgttgtgttgagaaatgggagcaaatccaagaccaaaaatcagatgatttattaaatttgcaagttaaaaaaataaatacagtttgaaagattgctctgtttgaggaaaggacatacaattttgttgagataacttagggtacaaatcaaggtcatttatgttcatttgaacattcatattcacatccggaaatatccagaatgactacactaaaacctgcaggtaaattcttttctcagctgagcataccatattgttgtagttaatcaagaaatctaccaaaattaaatttgtcctcctactttttagtttagaaatttagggggtcactgggactcaaaagaaaattcaataaataatggaccatcctagagatacttctttttaacttaaaaatccctctgagatatcctcaggttttaaaaatacctttgtattttcctgtttttgtgtgtgtttgtgtaggcctacatcttcatattagtcatcagtgttgtcagaaccttggctagaatcatagtctagacctcttgaggtcactgggtggttggctacattttccacctcttgcttttcatgggtcccactctgagaaacatgctccttctctctctctcctctttcaaggtcatctttgaggacatcttctgaagctttttctgagatgctgcctcttctgagcacgacactgtctattcttgtatcaccagtataggagctcatgcaatttgtaagcacttgccttaatgatgcgctccctgaaagaccctgaggagagggatcaggtggcgttcatctttaggatcccttccctgtcctcacagcacattcatggtccacgttcagcaaacacttgtacaatgacatgacttagggtttctagacaatctgtattgtaatttctgttgatataaagggataacattagcatcatatgaaaagtcagagttctatcaatgtcatcttgatgaaaatatttatatcgttatatcttatgtcctaggtgtcttcttgactgactacccagggcgagttggaatggctatgtgcatctctctgaacccccaaatctttagttgtaatgatgaacttacatggagaggcttattcgaaacgtcattatagtgtggatgataaccttcttagtttccacagctgatattcctccaaagttttgtatgctttgactaatgtattctctttatgctaagctttctttaaaatgatatgaatgttccataaatgctgattttttttgttttttgagacagggcttcactctgtcacccagggtggagtgcagtggcgtaactacagctcactgcagcctctgctcctgggctcaagcaatcctcccacctcagcctgtggagtagctgggactacaggcgtgcaccaccaaacctcgctaatttttgtatttttttgtagagacagagtttcgccatgttgcccaggctggtctcaaattcctgagctgaagcaatcctccctcctcagcctcccgaagtgctgggattacaggcatgagccaccacgcccggccccataactgttagtttaattagcacctttctgctttagttcatgttgactattgaaaatctatcatcctgtataattaatgtttttaaaagatacttttagatagtgatcaaaaacttatttattaagtagaatgtaaattattacaaatgatatgaataccataggataaagtttttatatgacaacttagattataaaatgcaattctagccaggcacattggctcatgcctgtaatcccagcactttgggaggcccagcaggcaccaaccgcttgcttccaggagttcgagagcaaccagggcaacatagtgagactccgtctctataaaaaatacaaaaaaaaaaaaaaatagctgagcatggtggtgcatgcctgtagtcccagctattcaggagactgaggtgagaggattgcttgagcctgggaggttgaggctgcagtgatccaaggttgcaccgttgcactccagtctaggcaacagataaatatgagtacaaatggctgatcatcttcatattaatatgaaattgcattttttgatacaggatctcgttctgtcttgtggccttctgtaataggttatcttgtccaaattctggaataaagtccagaagaattttaatctagataatttattctttaacctttgaaatattgtatcagctacatgacaatggcttataactagctctaaataaatgaaataacgtttgcgagagtgaatcacatcactgagaaccaaggggaaacatgaaatagtgattatttgaacagagagtgttagtggtctgcattctgccttgcacccaaatggcatcacctatgggtgtgataaaaagcccctgcctttctctccctcctcagtgcttgggatttccaacaacagcaaaagagaagccaggaagaatgctgtgttgtgagtacccccaggaagggttttcctttatgaagaggcagacctagttaggaaatacataaccatggactgcaggaaagacagttgagtctgcatggaggatagagaccagggaccccataaaaggagaggtggtgaccgaggcctgcaggatgcatggaaacattcctgacctcaagggcagcaactgtgaacacactcctactaggcagaactagaatggatgaacagagttcttttcagggagactcaccaggtagatgactacacatgagacacttttttttttttttttttttttttttttttgagacagagtctcgctctgtcgcccaggctggagtgcagtggcgccatctcggctcactgcaagctccgcctcccgggttcacgccattctcctgcctcagcctcctgagtagctgagactacaggcgcccgccaccacgcccggctaattgttttgtatttttagtagagacagggttaaaccgtgttagccaggacggtcttgatctcctgacctcgtgatccgcccacctcggcctcccgagtagctgggattacaggcgtgagccaccgaaacactttcagtgggaatattttgttccatcagattttagcaatatcggatttgaaaataggggaagcacacacagatacaattagtttcaccatctcacttgtgtatttaaacaaacctgtaaacaaagctaagcgaaccaagaaacaaacaaaacctcaaacctaatacagtaataataggctgggggtggtggctcatgactattattaatctcagcactttggtaggctaatacagaagaattgcttgagcccagagttcgagaccagcctgggcaaaatagtgagatcctatctctataaagattatttaaaaaattagccaggtttcgaggcatccacctgtagtcccaggtacttgggaggctgagaggcagggggatcacctgagcctaggaatttgagattacagccagctgtgatcgtgccattgaattccagcctgggtaaaagagtgaggtctgtctccaaagttaataaataagtaaaataataataataatttttaccgtatcacaaaaaatatagccagtcagatacaatgcacactaattattgtaaaattttctgaaacacacatacatcactaacttgataattgtaaatttaacactgattggagggtgtgaacaaaggtatgatcaagtaaaataaatgtataggcaatttcaaagtcttaataatacaatttcaagagctaatattaattgagcatttactatatgcacactcatgcatcatgggactgtgtttggtgctaatatcacaaaactttattttttcttccactggtaatttttgtcactgttgaaaactgtttcagccatggatccccacagtgcggagattgcgggatgtgggagagaaatgatggtctcaatccccacctgagccagtgtcctatggcaggcaggtgaaagccaagccacccagcttgagttctggctccacttttatagttctgtggtgttgggcaggttagctaatctgtccctgcattagtgttctcaactaatggggataaagctcacatataccttatatgtttttggagacaattaagagttagtatatgtaaagaattcagcaagttagatgctgacccactatgtacatattagctattataacttattattcggacaaacagctaatgcatgtggagcttaatacctaggtgacgggttgataggtgcagcaaaccactatggcacacgtttacctatgtaagaaacctgcacattctgaacatgtatcccggaacttaaagtaaaataaaaataaaaaataaaaaaataactattattactactattattagaattgtttggatgaggaggtagcttgatatcttgaaaaaatgcatggtctttggagtcaagataggtcttactccctgcttcagtgagctgcgttacttaacacctggatatcatttttttcccaatgtaaaataagatgtcataataactcctgcccttggctgtagaagggtcagtgaagatgaatgttattatgattgttgttaaatataaattcatttttacaaatacagtttcatcaacaatatttatgataatgcctattaataacaaaatgtgctaggtgttatgagaaatcaaaaacatagttaaaatatgatcttgtcttcctgtaatttaataatgtgctggctcattagctatgaaacccaaaggccttatctactttgtattaatattttttcaagcatggaagtaagcccagaagggtattgagtgatgtatcctcttcttcccttaccatctttcctatagatgcaaaatcctgagtgtgaaaggccacgtggtactctgttagatatctcgcaggtgttacttatcgatggttcttgcttaaaagtagaaggaggagtgtcgcatgagacgcatcctataaagagagcattccgggtgagatggcaagaaaaactccgaatggtcctgagatgataactgatccaatggagatgatatatctgttcagttgacgcaaacataattgcggtttatacccgtgaatgtaaggcaaaaactgcaattacgcttgcaccaacctaatatatatatcttttggagacagggtcttgctctgtcgcccaggctgtagtgtagtggtgcgatcacagctcactgcagcctcaacctcccaggctcaagtgatcctcccacctcagcttcctgagtccgctgggaccatagacacatgccgccacatccagctaattttgagataagttttcttgcagtagagtcaatggcagtgttgttctgaccttctgccacagcaaaacatctctgcaggttgaggattagttcttgcaaataagtgatttctaaatgattgattggttcttttcacacattttgcagatttcttttattaaacaagttatatctaatggagaaatacagtgagttgatgatctccaacaaaactttaatgccacccagatcaatgccaaccagattatgagttgcccattggaaacctcaaggagtcttcattgattttgtattctcaaactgcatgtgtgtgctaaaatggttgcatagagattccacatgcagccatgcatgtgtgtaggtgctcccactagactagttccttgacttattagggaacaagttaagaattacttcatgtcatgatcggctagttcttgtaactacccataagaaagcttataaggaatgtcacattggttttgaaacaatatcatctcttttactgatggagagaggtatgtttttctttttttttttaaatagggaacaatgtgctaagatggaaaaaaaaaatcaagtaggtttccagggaggcatttttttttttttttttttttttttgagacggagtctcgttctgtcgcccaggcgggagtgctgtggcgcgatctccgctcactgcaagctctgccttccgggttcacgccattctcttgcctcagcctcccgagtagctgggactacaggcgcccgccactgcgcccggctaattttttgcatttttagtagagacggggtttcaccgtggtctcgatctcctgacctcgtgatccgcccacctcggcctcccagagtgctgggattacaggcgtgagccaccgcgcccggcccagggaggcatttttaaaggcaccatctcagaaggacgaggcaatggtaagtatcaggaatagttattggcgagtccagcacagcagtcaatgactgtgttctggactgcaccgttggactcgggaaccactgtgtggccaggctgtgggctccggcagttgttcaaaaccctgaacctggagctcagaccagagggttgtatgggaggctcactgtcattcattgtaaccctaagaacctcatccttccttgagcccgattgttcccatctgatcagagcttagatgcaagattgggaagaaaggtggtggagttggggtctgcctggaggacagcccaggtgagtcatgcatggctgggagagcagtaggttcattctcaccacctcatttttctaaggggaaacagatccacaagggagggtcagccccagatcattggccacacttatgggaaacatgtgctgctgttacgcaggccccttcattctgtttgcatgctctccttgtaacccctgggcctatcaggacgccagggtgtctgttggaagaggcatccaagaaggatctttaggctgcaggatggaagcacacactacagcatgaccttaggtagatggttcattcattaccttttaatatcttcctctttctttgctgtcaaacatgggtaataaaatacctaacctgtcatattataagaagtaattgaggccaggtgcagtgggtcatgcctgtaatcccaacacgttgggaggctgaggagggagaatcacttgggttcaggagttcgagaccagcctgggccacacagtgagacttcatctctacaaaaaatttaaaaattagccagacatggtgatgcacacctgtagtcccagctacttgggaggctgaggtgggaggatcgcttgagctcaggagtttgaggctgtgtagctgtgattgctccactgcactccagcctggccaacgagcaagaccctgtctcaaagaaaaaaaaaattaggtgaaaacaatgtctatgcaacgctcagtgcctggtgatgtctaaggaatgcccaaactttctaggtaaggggtaggggatgcattgggtgagagtcccattggatgagcatgaatgggaactcatcaatattgctgaaagtgcctgatccagaattaaaatatttcaacagaaaattcagaggaaactttagaatgctgaaaaatgccatattggtcagtcttactggttaatcgacttttctgaagtacatacacactttttttttatttgagatagaatctcgctctttcatccaggctgtagtgcagtggcagaatttcagctcactgcaacctccacctcccaggttcaagtgattctcctgcctcagcctcccgagtagctgggattacaggcacccactgcaacgctcagctagtttttgtatttttagtaggggtgaggttttaccatgttggccaggctggtcttgaactcctgacctcaggtgatctgcctgcttttgcctcccaaagtgctgggattacaggtgtgagccacaacttccttcccacccagctaatttttgtatttttagtagaggcagggtttcaccatgttgaccaggctggtctcgaactcctgacctcaagtgatccatccgctttggcctccaaaagtgctgggattacaggcatgagccactgtgcccagcacacacttcactttggatcaagccccctttagagcatctgaacttcttttccagtcccttgttccacccaggcaatcccaagcctggtgccttcctatctctagcctttgatttaggctattctgtctgcctgtgtgcaacatttcctttccctccttactgaagttctaccccatcctgtgttgcatgagttgatggataattttgaaaaaataattattggtaatcattaacctctactgacttatttcattgatgcatttttgagcctggttaaaccaagtctagcagtgctttcggattactttggtggtgaaaattgtttacttaaaaaaaaaaaaacaatttgaaacaaataaaagtagaaagcagtggtttcaagctcatttggagtgtccaaagtgacatgcctggaaatttaggattttgaaataattgtctgctcctcctcatggccacacttcggggtacatctcataaagtagacaaacacagatgaaggtcacctgtctgactcactgtatgtaaacctctcagaaattcacccttggctgcactgctcaccggaagtccattttcttctagagtaaagatttgcaatgatctaggactcaaaaagtccatcttgggccatttgaatgaccccagcatctcattttaccctttgtatttgtagcccctgcagagtggggttcaaaatgtcagacaggtactactagtacaggcagaggggacactcagaccatgagatccttctcactgtctggacattagaaagagagcagagcccaaggaaaagatatgggtagaatacttttgtgatatacagctgtgagcccatgttagtggagatatttcacaattgaaaatctggacccttccccacaaactcaaattttagaaaggttcatctgatgctttcatacatctcaagtaaatggctctgtcttttcatggttcagctgcaaatctgaagtctttacaatttgattgcttaaatattggttattgacaaattttcttatcaatttgaatgttgtagcttccaaacttttgtcaaaatttagaccacaaaggccttttgagtatctctttaatgattgccagataattttcctatccatggctttctctttacagaataaaacttcagtatttttccttgattctagaagattgtcaaggtcatgtcctttatggaactcttgtttccaacaaagttgatttttaaacatctctccatatttcctgccataaacaaatactaggttttgtttttcaaagataatttgtaatttataaagaaagattaatgctgtcccacctcccccatttgatcattaacatacaaattggaagaaaatcatacttggaaaaatgattgatcagctgtttgctatttttatctagtatagatttatttgtcttatcaaaggtaaaacgaataaaggtacacatcatttttcatcagcatatacagctaaataatcaataatgatacattatgtaaatccctttggctcctgaattacacgactttctttttttccattttcttttttttcaacctggatgagtcttaataaataatcaaggcctgaagtctaagaaatgtttgtcttctctctcacacttacagcctttggaacaggaacccaatgcagcattggttgtaattatttcagtagctgcagtgcaaagcacattcaggtgaatataatcagactgtcctagttccaaggagaagcagtagtaacaggtctggcatcaggctcagagctatagacgagtcacagcttataatatgatagactcactttatgaaacccaaagggaacattatataaagtgcacaatcatgagaaggaaatgagaacttctgaacctaggacttttttaaaattgttttaccatatgcacttaggttcaaactacatttgaaaccactgggcattatcagtatgtctctgcaagagtcagctactgcttttgcttaattggtagctgcattttctcttaaggggggaatgctttggagtgtgttttcctgataatttggagtggtctttgctgaatggtgatcctaggttggaatttcctacattgtacaccaagaatcagttggctggatgaaaaacaagtgacaaagggtttttcctttcccagtattctcaaaatcctcagtaagaactgaaggcatcatgactcttcagtgacatcagttgtccttgaggaggggtggaggatttcgtggagacacacataggcctgataatgaggacatctatgctgtaatccagctctgctgctaattagttgtttgcaattactaggtttttggtatgtttaaagactgcagagacaggcattcattccttttcactatgaagaatgtgtgaatgtaaattaagaaccacagctagctgagaagtacaaataatttgtgaagcctatttaatactcgaaaatttcaatttatgtcagttcattcaatttttctacatacagttgactgaacactttctggttttgtaacccctattagggaaaattctttgcaatggattttcatgataatctggatagtcttagtgatcttatgttagaatttattttattgctaggatgacttagtccaattcaaaactgatgatcaagaaaaattcctttcatggcattcctgaaaacataatttttaagtcaagggatgatcaggataattctaggggcctgtaagtttgaacattgagattgttgatactaagttctgaacacatattacccaaatgaatcttttattaaacattttgtggtttcaaaggacatagagtagttatgcaaatcaatgtggtgcagcaactacagtataaccttcagatgttagggaatcaacgactaaaaaaaaaaaaggacagtatttgaatgttattacaaagacacctgcgattcttgaaggacatttcaaaggcagacaatggggtaaattgtgattgaaatacacgcgcaatctctatgatatgctccttccacttagaaagtgggatgaaagctcatcaattgaagagtaattgctaaaaaagatttctcctctatctagcttgggagtatttaggagctaatcagagtatttcgtcttctcggaaattaaaagagatgaacagagttgtgcagacatggggaaaataaagtttagtttaatatttagattttaaaattagtacttgatggacattttaaaaagtgtacaattatcaaaacttcaatatctaatccttttatgtaaactatggtggatacatggaaacaccagggacgggtgctggttcttgttaacttttctttctctgtcagccacaagagtgcctgtcccatagcagtaaactaataagtatttgctaaattaagaagtgggaagggcgttgtaggttattgatcaaacgaaaataaatatattttgttgtttattcaaaaatttccccgacttaatttttttaaaatgtaacttaattttttaaagctcatctgtgtttctttgttttgtgtcgagtcaaagattattttatgtcaattaccttttcatgctgaggcaacagtttcagttttcccattctgcaaaactaatttcctgattcctctctcaccagggaccattcccctccaaaatcctacaaggtgggtccatgacatctgctagagaaaaagagggacatgttggagcgataggattcccatgggcactgacatactggcctctggggataggaagattaatgcttagtacaagaaagaaggaaaagaaggccttggcgaggactgttttatctcagcatttctcagaagctccttcagtggagacttcgcctgggaccttcgccccaccttcttctaatggcacttcctccctgtggggctccacgcgggacattacgtcggtgatgcgtagggcatcgggtgcggaaatgtgtgcgtgcctcctggcgtgtgcgtgccttctggcgtgtgcctgtgcgtgtacgtgcgcatgcgtccgcctcccgggttcacgccattccctggcctcagcctccggggtagctggggctacgggcgctcgctttttttttttttttttgtatttttagtagggacggggtttcaccgtgttagccaggacggtctaggaaatttttaagccactctgactaaagaaggtggagttggccgggcgcggtggctcaaacctgtaatcccagcactttgggaggccgaggcgggcggatcactaggtcaggagatggagaccatcctggctaacgcggtgaaaccccgtctctactaaaaatacaaaaaaattagccgggcgcggtggcgggcgcctgtagtcccagctactcgggaggctgaggcaggagaatggcgtgaacccgggaggcggagcttgcagtgagctgagatcgtaccactgtactccagcctggttagagtttatatttcctttaaatttctagagaaaacagattgtcatgtatttttatagagacaaaatactgatgaaggtgatatacaggtagcttaattatgatttttctaagatttaattagatggtaaatttacagtaattattaatatgttcactgcttttattaaaaaccatcaattctgaatccacaatgacacaaatggtgagtaaggcttatgtcttgtatctgtgttctttcagtgcttaaatgtcaagagaaaaacaaagacttttaacatgatttttaaggaacgttttcattctatggtggtttctaatgtatgtgtttgtctttagacttcctttatccttttcctttcatctctttctcaaactcataaggtttcctttgtgcagatacttttttgcctgtttttcctccctagtttatgctgcttttctgtcaagaggctatatttcagaatgggaaaaaagggcaagcatatatagttaaatgaatcattttacactgtttgtaagttattatacataagctaatgtttgatctctggaggataaaaatgagctcaagtttgagcaaatgatggtgccgcacacatgccctaccttatggtgagtcaactatggcctatgggtggtggccaatttttgtaaataaaatgttttgcaacccaaccacacacttaaatttacattttcatatatggttcttttatactacagtgccagagtggaatggttgccccagacactgcatggcctacaaagcctaaaatatttatcatgtgatcctttaccagaaaacattggcaatgcatactttggcaattcatggtgatcatcttgggcctatgagttaatgcatccgtgcatacattttaaattagaaatatgtaatacattagcattaacaacagagcatatgcttttgtattaggaattctatgaatgcatgcactacaactcttaaacacagagcaagtttaaagcctggcatctggggtgtatggatgagtggggcctgggaacacccttgaattttacctgtaaaatttatgtgcaccagggaaagattcagtggcgttcaacaacacaagaagctgcagctggttcgtgtgggttttcattggtggtctctagctgctcaagtgatggattccagttgctggttgatctctcttagggctaaggttcattattgcacagattgatcttggagaaacatcttgactgtttttttcacactccaatccatttgttttatgatctagaagaaaggaacgcttaaatgcaaacaattattgtgatttttattccgcttcactgaactttttaatgaagtgcattttgtacagttaaaaccagggggttcctggattctattttttgtgggaatttttgagagagaagtaattctgactcagtacgcttccttggagtggataattaatattaatggggaatggaattgttttgtctttcgctggcatgttgttctctgccacacctggcatgctgtggacctgtagtaaatattaactaaatatattttagacacagatgattaaggatcttttgctgaaaaacattctcttaatcttttatacttccctttccacagtgcctgctgaaaacatgaatttcaattgtgtttctaagtcttggtcaatttaagtgtgacatggggtgatggggaaatagcagttaggactaaaggtagaaggtaacatgatccatgtgaattgtggtcagtgcaaaggcctggaacagcggtcactctttcctgtccatgaacctttgtgctattcctctttgtacacagtttaaaatataaataagaaaatgtcatgctgccaagtatgtatcacagtgcaggccacgtagaagatgctttatatgtgttggatgcaggccagtgttctcaactcagcagtttcagaggaagtgaaacaagccctggctggaaaccagtagccgtaaggtctaagtcctggctgagcagtccaaatgggttccctaacctattgcccatcccctcagctaagaagggcaggcagtgcccctgggcaatgctggttttatccaactctcagaaggcgccattctttgcctacgctctcccgtgtattggtccaaagcccaccaacttcctgagtggagttccttcacattctgcagaaaaccttctgtggtgctttaacattggatgggaagatgaagttatcttgggctctgggctatgttagtcatgttttggtaaacgaagcattctgttttcaccaggggatgagtaggtataattttccttcttgagttttgcaaacctgggtggagaagaaaatcagtgcaatgtcttatgaattttttttttaatagaagatagcaacttggaagcaattgagtgttgagtctaagagattccccaccccccccagcatttgttctgatctcatatatatgtacagaaaaatataaattatttagcattgacttatctgtaattaagtcttctaaaaggactactgttttagctgctatattttcttctcaattacttggaaaatttaaaccttccttggggaatgtttagtctttcacttgtccttttaatggtaattgattggattgttcaaattatgctgttctgagaagaagttaacaaataaaatctggcaaagtaataagcaaatggcatcaggtaaatgaaaagaacagcacactgtgtccagtgatatgtgtcttcactaatttcttacctttcaaaagttgaagattgataatcaaggtaaactttaaaatggaaaatttgccagctacagattttaaagttcataaaaggtggttttttgatagcttttgttgctactatttccatttagccttttataataattagttaaaaatctcaactaattcttttgataagatatcataggttgtatttttcaatgtttaagccagatacttgcttaaaaatcagttaattaactgagagtgaataattgtcatttattattttatatttgaaatattaggttatagtttaaacattttacttaaagtgtaactagaatactggacacattttgctaacactcagtgttttcaggtgtttttaaaatcatcaccatttctatggttaagtcttagaacaacactctgaaatgatgtggcatcaaccatctgagaaagtaattaaaagggataaaatagtaccacatgagttgggattccttgactatccaaccaaaaaattaccgattttaggaaacattctatttaatctaattatccttcaaagtgagtggacctttgacgtcattttcaacagcagtgccatcttgtttttgtgtagttgaagatcagttcattgatcttatgtctcaggaagaaattgcagtatttcttttttgtcttttttttttttgagacggagtcttgctctctcgtccaggctggagtgcagtggcgcgatctccgctcactgcaaactccgcctcccgtgttcatgcatatctcctgcctcagcctcccaagtggctgggactacaggcgcccaccaccactcctggctaattttttgtatttttagtagagacagggtttcaccatgttagccaggatggtctcgatctcctgacctcgtgatctgcccgcctcagcctcccaaagtgctgggattagaggcgtgagccaccgtgcccggccagtatttatttttttggtgtttaaaaggttaaactgctttggaaagaaatttcaaaatgatttgggttttccgggcttagaaagcagactccagctctaatagtatatgctttttttctacaaatgttttccactagatggttatagagaatcgtttcaattgatttctttctgatgtcttctctatttggaaatgcagtcgttcacatctaatggacactttctagcagccctgtttcatccctcctgtatacttcttaactaggattccagaaggagcagtcacatttgtttttccttactttccactccttcttcagcatgttcatgttctcagctgtaacacataatcacaaacttaatggtttgaagaacactcattggtaaacatggttctggaggccactttctgaaatggacctggtggagctacaatcttagtgtcagcagggctccttccttcggaaggctccaagggagaatctttctccttgtcgttttcccccatggaggctacctgcgttccttagctgttgtggcaggtcacatctccctctctgactctgaccctcctgcctccctcttgtaagggcccttgtaatgccactgggctcacccagctaacccaggatcatctctttatctcaaaatccttaacttaatcacatctgcaaagtccctttgccgtgaaaggtcacatattcacagactctggggattaagatgtggatagctttggggacagtgcattattcagcctcaggatgctataatcgtatgattgatgcatctcaggggtcatcttagttggcctctgcaacatctttctccctcttgatacctttcctgggatgctttcctcaacatctttgacaacactcttgttttccctttttctccctgatggctgcttttctctttattttccttcttcccttgtctctttccctcctccttgctccatctcccttgggaatcccattgtacattgtatactcgatggaaggtatgtttggaatattatcacgtgtgtgaccaaagactgatggccagtgaaatggtcttaggtgatttggccctaagttcccttttctatcccatttcatgacatctgtctacatatcctgtgtctcaggcatgttgaaggacacacaaccttctggtaccagcagtgtttagccacagacctccgtgtcactgttattgctaccttcctcccttgcctgacttttctccctgcagtggaggtcctaatgattccacattcacctgaaagtcatttctcaagggagccttccatgacctgctccccctctataatcatgtatccaaaagagtacccccatgataaccctctttcctctcttgttaatttcaatgccttacttccctaccagactaaaaattcccctgaatacaggaaatatcttacgttattgtaatcaccactccgtctaatgcagtgccccactgctatggtttgaatatcccctccgaaacttatgttgaaacttaattctcagtgtggcagtattaagaggtgggcctttaagaggtgattggatcaaggattaatggattaatgtgtaaaaggattaattggttaagaagaaggagagagacctgaggtagcactgagccctttggctatgtgataacatgggccacctcaggaatcagcagagagtccctattagcaagaagcttctcatcagatgcagccccttaaccttggacttctcagcccccagaactttaagaaataaattccttttgttcataaagttactcagtttcagatgttctcttataagcagcgggaaacaggactactaagacacacagtcaaaaattatttattaaattaataatattaccataaaatcatagtagttaaatctgtgtttagagatagtttcactccttttagtctatcacttttaaatctacgtattcatgttagttccgtggtatgagcgtctgtgtgcatagctgtaattatagtgtaatagattactaaagcagtcatgaaacacttgagggttctttgtaccaccgctcaaatttatttacatccatacacacttgtcaaaagaggtagagagtttcagatgcccttaactatccttattccccacaggcctaccctcatatttctgatagcagctgatataccagggagactgaaaattaagttccatcctaagcacagagacttaagagttgctgtcacttagagagagagagaagcaaactattggtgcctccgaatgcaatattggttttccccaaagaatgctttatcttcgctttacttaaagaaaaaagcagggcagggcagtggaaatgaactgataaccttgtgtctgtggatataactctgctccagggaagacattaaagggtaatgctttgaaaataacatcaagaaatgaaagttaacataaaaaaaaaaaagctgtcagtactttaggtgttccaaagtcctgtggagagtggcttaactggagtttatagcaactctgagacatttttttttagtacagttctgccactactttctatgtttataaacaatgaacagatgcattcagtgctagttacctagaatcaactctcatacccagcattacactcgaacgttgaatgttgtattagtccgttcttgcattgctttaagaaaatacctgaggctgggtaatttataaaggaaagaggtttaattggttcatggttctgcaggatgtacaggaagcataggggtttttgcttctggagagtcctcagggaacttacaatcttggcggaaggtaaagggggagtgagctttcttacatggccggagcaggaggaagagagagagaggggcaaggtgctgcacacttttaaacaaccagatctcatgagaactcactcactatacagtaccaagggggccgatgctaaaccattcatgagaactccgcccccatcatccagtctcctcccaccaggccccacctccatcactgggaattacagttcgacaggagatttggatagggacacattttcatcttaatttgtattttggtatagtttcataggaaagatttaggttggtgttctctcgcatggaaattcacttagagcttttacttgcttgttacttgttttaaagcctttccaattgaaccaatttattaagggcatctatttaattttctatggtaaatgtactaaaaactagaagagatcttactgccttgatactagtttattgcttgtttattaggtgccctgaaaagataactttagcatccactgcttgctaaccatccttgtcttcagcatcattagaagatacgaaggagtaaggaacgtgcttatgagaaaacagaagctatggcatcccccatcatagccacatgagtcttgaataggccgcctgcttctctgtcttctttttgcaagtgggttgcatcctagctttggtggtgtccttgtaactttggaattgcctttgagagaagaccagtctgtctctttccagctgctggacctgagagattgggctgcaggtggcaaatggtcgctactgagaaaactgaaagcaatgacagccatataatatggtgtgaacaccatatggatcaaactgggacatcacagtcagcacacactcatccaattctcagaccaaggcacaccatgaaattctgacatttaggtttcctgcctcttaggaattccatcaaaattatataagtagcactattctaaattttaacctactatcattttaaaaaatgacttactcacagccctaacactcatcggagcaggttgatattgtagaaaactctagccctatgcaactggagtgatcttgatgctaagacaatatgacccaaagccttgtcctttcctcttggctatatgaatattttctaacttttgtgaacaaaatatgcctctttttcctcatgatggtgtttcaaaatgagtcgatgggtgtttttcagttattagtggataggagctctcttagcttagtccttcaaaagcttgtgtttgatgttgtagctttgtaaattatctcaatgtatgcatacacacatactcccctaccaaaaaaggtcaatagatgcttagaattccttccttccttccttccttccttcctttttttcagggtcttgctttgtcgctcaggctggagtgtagtagtacaatcatagctcactgcagctttgagttcctgggctcaagtaatcttcccatctcacacctcagcctctcctgggaccacaggcatgcaccaccacacccagctgatttaaaatttgtttttttagagacacggttttcctatgttgttcaggctggtctcgaactcctggactctagtgatcctcctgtcttgtgctccttggattacaggcataagccgccacgcccagccacgtagtatttctatattttacttttagcataagtccgtgaaagaactatatttctcatgctttgttcaactgtgcacatcatgatgttgaaggatttgcacgatggctatgatggtggctgtcactgcactacaatactttttttgaaaataagtgaaatattcattgttcactagaatagtcttacaggcatttgtttctttagaatttggaaacttctttttatattcatggtcgtatttcattctgctagcagtttaggcagattcaatctgtcccactttccagtggtagaaacagtgtgaagaagtgaagtagttgttggaaaatcactgtggtttgcttcccaggggttgccttgtccactgattacaaaagtatcataacacatggcatcttcccacaaggagtttagagtttgaaaagtcaatgtattaatgtacataggggacccacttccactcaaagcaaacattgagtcaggtatcagagctcggtgggtgaacacgatggcatttaattatcctaaattactttatataatcaatatctactaactgcctttgttatgatgctacccatcatttttggagtcacaagctttcaacctttgtctaactaaaagatggatatctgcattttatattaggtggtctggaagccatagtaatattagagagcacatagggaatgttttagtccatttgggctactataaggaaataccatagactgtgtagcttataaacaacagacatttattgctcaattctggaggctgggagtccaagatcaaggtatggcagattcagtgtctggtgagcacccacatcctggtttgtagatggtgccttctccctgtatcctcatgtggtagaaggggtgagggagctgagttcccttttatgagggcactaatcccattcatgaggctccaacctcatgacctcatcacctcccaaggacctcgcctcctgataccatcatcttgggggtcacaatttcaacataggaatttggaggggcacaaacattcagatcatagcagggagagagatgagccttgcccaactccatgaagccatctagattttttcagtctcagtcctatttccattttttaatgttgagttttgaactctattaatgtctcctggtattttcaaaactttgtagagctttcatcatcaatattaaacctttcacattcaaaggacatgattattttgtgtgagtagcgtgttgttatttgacaaatgagtacaattataaataaatcttgaccatcttgatagaggaaataaatgcacgtgtcaagatatactataatgcttttgtaatcaaaacaatgatggggccaggcgcagtggctcacgcctgtaatcccagcactttgggattacacccactgaggtgggtggatcacttgaggtcaggagttcgagaccaccctggccaacatggtgaaaccccatctctactaaaaatacaaaaattagccaggcatggtggtgcacgcctgtaattccagctactcaggaggctgaggcaggagaatcgcttgagcccaggaggcagaggttgcaatgagtcaagatggtgtcactgcattctagcctgggcaacagagtgagactctgtctcaaaaacaaaacaatcaaacaaaaagcaatgatggatagaacagggtattatttaaatgaaaactgtaaggggagttgtatgctctcaaatgtcattatgcacagtctaatattttcccttttactttgtcactctacctgctaatttgcttccttaattcagagttatgtctttggttattagttataatataggctgacagttatgtagcgtttcttctgtgctaggacctgttccaagtgctttttatattaactcattggtctcaaccactctacctgatagttaccattagtattagtttcctatctgtgctgcagtaacaagttactacagacttagtggctgcttacagctctagaggtcagaagtccaaaatgagccttaggaggctaaaatcaaggtatcatcaggacaccgttctttttggaggctctaggagaggacagatttccctgccttttccagattctagagacttcttactctccttggctcataagttcctttctgcaccttcaatgccagtagattgagtccttctcattctgtcatctttctggttcttcctcttttctttttcccttttctacttataaggatccttgtgattatgtggacccactggataacctggaatcatctccccatttcgaggtctgctgactgggaaccttaattctacctgcctctttcatttgaatctcttttccatgtaaggtcacacaaagtcacaagttcttgtattaacacatggtcatcccggggggtccgttattctgcagaccacacagttgttatcttcattttacagacaagaaagacaaacagtgagagttaaatcacttactcagggttgttgggctgctaaatggtagagccagttaaaattaggagtgtacacagggaagctaggcagtgttgtggtcaagggccttggccccctgaaggttcaatgaaaaatcatggagacaaagtgatttttactgtccactcaactggattgcacagagggagagagagaccaggagcctggctggctggtgagaaattcttaccctttggccagcagtgtgggttcctgggttctctgcactgtggcttccaaaagagcagagcgtctttgttgaccccgctcgctgtgtcataactgtaggggccaaggctctttactccctaaaattttaatgaaaaatcactgactaggcagactgattaacaggagaaatgacattacaagtgtatttaatgcagatacacaggagcctttggaatgaagatctaccctccaaatgaggtccagaagcttatacaccatcctgaggttacagaaagagtgggggcttggatcccagtaaaacaggtgatgggagggggaggtgaggaattctgttgaggagattattagaacagagattaacttgtaaagagttctctttgaaaattaaatgatccttggagacacccttggaaaactgtctgctcaggtgtggttttatcttgttttttttttttttttttctgtaatagataatgatataacttgaaggggttgaaaaacaactgtaggttgtcaaatgtatcccatatcctagccctcacttctggttccatcttacttttctatgtaagttttcacttctagttctatttcttacttagaaattgtgttaatcactggtataagtagcatctttgccagataaaaaggaaaaacaaaaacaaatgctttatgacgatatgtgggagaaaagaatgtaatagtacttgagaaatattggaactggttaaatactagatggtgttgggtagtgtttaataaaatgattatatttcatagagaacattttctctacgctgaggcagaaatacagagataattttatactatactcatcctttctcctaatcatattattttttaaaattcaagttagaatttgagtgattgtattgctgctgtgctgtttttctcagaggaaaaatcatagcaaattatttcaaagatagatggagaacatggtgtttctctatatccaggttggattgaatgttgtattagccaatggaaaccttcctcttcaccctctggagggtcacggaaaatcatgtcacaaaaggcagattaatagaaagcaatacatatttattaagttgtagatttgtgtaacacaggagccttcagaatgaggacacaaagatacaggggagactgtccaattttttttttatttcaacttattttagattcagggggtacatgtgtaggtttgctagatgggaatattgcgtgatgctgaggtatagggtacaattgatcccaatcaatggtggtaagcatagtgaccaccagctagtttttcagtcctcaccctactcacttcccattctagtagtcccctgtgcctattgctcccgtctttatttccgtgttttctcaagctcccacttataagtgagaacatgcagtatttggttttctgtttttatgttgactcacttaggataatggcctccagcagtatccatgtttctgcaagggacctgattttgttctttttcatggttgcatagtattccacagtgcatatgtggagaccacattttctttatttattccacccaccactgattggcatctaggttgattccatgtctgtctttgctattgtgaatagtactacagtgaacatacaaatgcatgcgtcttttttgtagaacgatttattttcctttgagtatatacccagtaacgggattgctgggtcaaatggtagttttgtttcatttaagtcctttgagaaatctccaaactactttccacagtggctgaactaatttacaatctcagcaagaatgtataagtgttccctttttctctgcaaactcactggcatctgttatatatttttttttttgactatttaatgatggcctttctgactggtgtgagatggtttctcattgtggttttgatttacatttccctaatgatcaatgatgtggagcatttttcagatgtttattgattgcttatatgccctcttttgagaagtgtgtgttcatgttctaggcacagtttttttttgttttttgttttgttttgttttgttttgtttgagacagagtctagctctgttgcccaggctggagtgcagtagcaccatctcggctcactgcaacctctacctcctgggttcaaaaaatcctgcctcagcctcctaagtaggtgggattacaggtgcccaccaccatgcctggctaattattttgtatttttttagtagagacagggtttcaccatgttggccaggctagttttgagctcctgacctcaagtgatctgctgcctcggcctcctgaagtgctaggattacaggcgtgagcgaccactaccagcccttggcacagtttttaatggggttatttggaaactcagtttttatgctaaggttcaactaactgtggacaacccagtagaaatagggttggacaaaaagggcctgatctaaagctaatggactgagtggggaaacccagccaggtctgtctgcctagattcttcttggcctctctgagcagcattccttctgggtgtgaggtaggaccctctgtggaatggggggtcttaggacctacagtcaaaaaggcaggtcagaggatttatttatggccagtgtttacagaaaggcaggggaaagttgaggtcatctttttttggtttcatgggtgctttgtggggaaggggtctggtttgtatgacctgctttagggaggagggattccagttcctatggccagccttcggggagaatggaattgagagacaacaggtcaggggagggtcagagaaaaaccttttgcctctgaggctgctgaagccttcattttgtggtatcattctctgagccccaacaacacaaatttttttaacttcatgcaaaactcttaggtcagttgagcctagaatacaggtttctacgctgtgtggctaaagtacggtccttccctcctctccacagggagcagatgaaatttattttggaggaagttaactcagaatagaaggacccagagatgtcagagagtggagtgggggcgagagcccagactccgtatctgtcctgagaaagttaggacataaggacccacagacatcagagagtggagtaggggtgagggcccacgctctgtgtctgtaagggaattgtctacactctgcatactcacagccatcagctttcttgttcttccttccaagttgaaagtcactggactccttcaagtccatcctggaggatccctttcttggtaaactgaactggcagagaaaagtattccataactggcatttggaggccatttgggcctattacttatttactgtacaatatgttcacctgctgaggaaggacccctggctatccacacagacctgattcttaagtgagaaaagacagtcttacatcctagatatttttgagaagctttcaataagaaattctttttaaaaattgaaaaaagaatcatctggaggtagcacagacaacaccaaccaagaaaacaagagacaaaatttctaatctgtaacttgtaggagatatgatgaaatagtgactcataaaaaacatgggaattctattaaaatgtgacatattaggcaaattaaataatcagattggagaacgattatgaggatatctccaatggacaaaactttaatgagagagagatagcaaaatggaaaggaacgaatatggagactctaggaatctgacattcgaagagtattttcaggaaggacaacagaatacaaataagcaaaagtgacttatgaataatttttaaaataatcccagcattgagggatctacacttccaggcttatgaaacaacactcagggctcaccatagtgaatgaattgaaactccaaactacaaaagcacattgcgagatttcagaagaacaaatatatagggaagatcctaagagcttggaggctgtattaggccgttcttgcattgatataaagaaatacccgagactgggtaatttacaaagaaaagaggtttaattggctcatggttctgcaggccgtacaggaagcatggcggctcctggggaggcctcaggaacgtgtcaatcatgacagaaggtgaagggaaagcaggcacatcttacatggctggagcacgaggaagagagagagaggacgtgctacagcctttcaaaccaccaggtctcctgagaactcactcactatacagtaccaaggggtgtgtacagtaccattcaagagaactctgctccccatgatgccatcacctcccaccaggccccatctccaacactggggattacaattcaatatgagatttgggcagggacacagatccaaatcatatcagaggcaaagaaaaaaaacttattaagaatcaagaatttgtaatgtcatagaatgcttcatgtcttcactgaacgttaaaagatagaaactttcacaattctaagaaaaaacaatttactacgtagaactcttggagcaaactgtccatgggcaggcagggtcaaggcatttacactgatgtagcatttccgaaaatttaccttttgtgcaccctttcttggaaagctgtgtgattatgtcttccttcaaacagcggaataaatgacaaatagaaagatggggaatccaaggaacagtggccttcacagaagagagctgaaagaatgcaggtctcagattaatgcccagagcaggctgggacagctggaatcctagagtgagacttcaaggagaaagtacataaaagaaaaggaaatgagccatttgaccatgtagaaatagtacttgagatgggctttagttcccttggaacattcagaaaaattgaacaatagacacacagaaaagcatgaaatgaaaatgtgaagttgttgttgtctccagataaaacaggaggcaattcaatgaaggagatttaattagagtagaatgcttcattcaggagtgattattaattgcacagttacaataaagttaaagagagaaggccaggtgtagtggctcacgcctgtaatcccagcactctgggaggccaagataggcagatctcttgagtccaacagttcgagaccagcctgggcaatgtggcgaaatcccacctctacaaaaaattcaaaaattatctgggcatggtggtgtgtggctgtagtcccagttactgcagaggctgaggtgggaagattgctggagcctggaaggttggggctgcggtgagttgtgactgtaccattgcactccagcctgggcaacagagcaagaccctgtctcgaaaaaacaaaaaggcagaaggggcaaatagagtggtggttgcccattgataatttataggtaatatctaaaaataatatatcaagaaaaaatagcataaactattacttagaaatatcatagagcatatatttggagaggagaagctaagaaatctgaaagcatttgctttctaaagcaagtgtggtcatgggatgttgtatgttgggcaagaaagtgctgtttgttgtgcaaataacacttgtagtagtttgacctttaaaacttcatgcatgcctttctttattgaaacaaaattttttcaaaagaaaaatgataaggccaagattgaatggtatgtgaatgtgaatatgacagttaaaagcatgatttctcaaatgtacctgcccattggaatcacctggagaatgtaataggtattaatgcctgtgctgtggtcctccagagattctgacttgctcggtctgcaatgcagactgggcagtgaaatttttcaattctccttagggattctaagatgcagcagagtttaggaagcatggatctaggtagctcagattcttacttgaatttaaaaatctctagctgggtgcagtggctcatgcctgcaatcccagcactttgtgctgggctgaggtgggaggattgcttgagcccaagagttccagaccagcctgggcaacatagcgtgcctgtgttcccagctattcaggagactgaggtgggaggttcgcttgagccctggaggtcaaggctgcagtgagctgagattataccgctgcactcaagcctgggcaacagagtgagaccctgtttcaaaaaaaaaaaaaatcttgtccagtgttctcttcaccaagatacagtggtttcagtaataaactactactaacatgatgatttagattgagccaacttcatcactcagtcatttctttgttatctgatatgttctttatggaaaggctttaattgcttgaaaatgacctaatgcttctcccaagcttcccatttttttttccctttcttaactgaagtcacagaatgttctcgtgtgtggaatgctttgtctatcctacgggaagccaattgtgcatggctcatggcgccatgctggcttaattgttccaattcctcctgtttctccgaccacacatgaggttgaattaaatataatttcctcagtttgcatttcccaggcagtcgtcctaagtggcttcttggaggagctctgtgcattccactggtctaattctgtgatgccctttaactcgagggccaaggacataattaccagctctagaaattcgttccgtggtcaaggatgcttgtgcagaggccaaattttctttcattataatttggcctttgccaagcttcaaagtgaaggggattgagttcctactaaagagtattggcacctaggaagtgaatgctttctctatcttttgcagctagtgtgttctacatttcttcaatgtaccttctgcctggtaaatgtcagattatttgttgatcatcctcagggtgtagttctttgtgttgttaaataagaacccagtggcttaaaagcattggcttttgagaagtcatttttatcctggatgataactcaaatccatgcagtgctgatatttacagctgggaggtgacatgatcttatcctttggtctgttgctcaaattattgatttcagtaggacttactggctcccttctgtcttggggatacctttgatctgtcttgccttgggggaccctccctctgacctggaatagcagcctatttccacaagaagggaccctctgagagaggacagtcttcataccgcctcttccgattttcctttatcttttatgggttttggctttataactttactcttagaatgtccttaaagctaatgattttttaatgttctctagtgtattactaaaagctcttcatctacttgaaagactggggcaggaagattgcttgagcccaaaaggtcgaggctgcagtgagttgtgatcctgccactgtattccagcctgggtgacagagcaagaccctgtctcaaaaaaataaaaaggacaggtgcagtggctcacgcctataatcccagcactttgggaggctgaagcaggaggattgcttgaagccagagttctagaccagcctgcaacatagagagacccatctcttcaaaaaataaaaaaaaaatagctggacatgatggcacacccctgtagtcccagcttcttgtggggctgagaccagcaggaggacttctagagcctaggaattccaggatgcagtgagcaatatgtatgtgttaatacatagtgaaaccagttattggagaattagtatatgtcctcccacaaattcagtatgttttcctaattatccaattaattcaaagggcataaacataatagatgcaaattattttacgttttttgtttaaaaacctttttgactgaatcagtctatgacgctttagtatttgaagttgcggacagaacttagtcttaagatagcactcgctttgttgatagatttccatggagggaatttttgccagatgataatttagcttgaagatgttatagatgtggacagtcacaccctctaagttacacagtctggggtgggccaattgaaaagaacatgcagaaacacaggcttgttaagggataattaaacgtgggggaaatagaacagtcatggcagaggatttaatagggtttaattgggttaggaagaataggccggagtgaaagaatagctcttaataggaggtctagaaatagccaaggaaagcattaattgcagaaaatctgtgacatctgattactgtagtgaaagaaagatccacctttaaaaatcctatctatacagaaagaagtgatagggagaaggaaatcttcccacggacatatttaagaaaaacagtggggaggtttgagatttcaaagggccatggttcaggttataattcaaaagagaggcaaatgatagtcctactcttcttgagtttcaggaagggggaggattttgccacttgctgtgaaataattttggagcttctataacgttgatcctttcatcctattttttcttggacttgggatgtggggagtggataagatggggatggagaagaagcagggtttgaaatgcctcttttgattctgttcattcccggaattcttctccatgggccttaaagagtagagactccttcccggtgcatgacatccagtggccaattaatgaaactttatttcctcagataagttcccttcctccattaatttgtgggaattcagatgaaaacttacttggactgtggttttctatgtgtttgtgaatggaaggacatgtttgtctttgaccttcctttagtttcacgtcttagtcttgatatttaagtagctttggttcagacagagaaggaccatgtgtgcagttgctgggactgctctctagcttggaggttccctggtcttgggaaagatctccctgccctatgcaggtggcatagatgtttaattttctacatgagagaagcgctagagtttttttattcattacttgtgtgcacagctgtggcctctagggaagctcagctgaggtggtctcaggttccaccaaaggttaccggggagagatgactaggaagacaggaagacctgtctcacttgggagggtatggcaagagctaggcaagacctcctggtggagatatttgccttttattctttcttttttttttttttttttttttgagacagtttcactctgtcacccgggctgaagtgtagtggtgcgatcatggctcacaccaacctccccgtctcgagctcaagccatcctcccacctcagcctcttgagtagctagggctacaggcatgcaacaccatgtccagctaatttttaaattatttttagaaacaaggttttgccatgttgcccagactggtcttgaactcttaggctcaagtgatcctcccgcctcagcctccgaaagtgttgggattataggcatgagccatgttgcctgacccatttattctcaagtacttatgctcagggcaggtcttccaagggaagagaacagccagataagactcgtatgagatagctgaggaggtggcatttcatccttccatgcacatgctccttatccacaagcagaaagctgtaacctttgctgtccccactaggtcatgataggtagatacgcaggtgatgaccacagactggcaattagccaaggattctcagctgtgcacgctacatgtgtgagtgtgtgtgacagatccctttggcggtttggtggaaaattgatacattttgtaaaaatgatatgtttaagtcatacaataaggtaaataacgcataaaaggaaatcggttttattgaaatagttaccaaggtatattaatattaatatttaaagttggtgcagtggctcatgcctgtaaacaccagcatttggggaggctgaggtgagaggattgcttgaggccaggagttcaagaccagcctggccaacaaagtgagactctgtttctacaatcaataaaataaaaaataaaaataaaaagatatatttaaactgggctacagtaatacatgtgcatctttattgtgtgctaagtacctggatctacttaagaggttcgtaatagtcacaatttcaaagtacaataagcgtaaacagtattttgggatatctgtgataacagtgttaagtgtcctacctacacgggtaatggaagcaaatactaaatttcagtgcatggtagtgaaactaaagatgtaattacttttgcccattgcaatttgtagaacccatggaatctatctaaagactcctgggtggcaaaggataaatgcttgagggtatgataccccattcttcatgatgtgattattacatattgcatgcctgtatcaaaacaactcatgtgccccatatatatatatatgtatatgtatatacacctgctatgtactcacaaaaaaataaataaagacacctgggtgggattggggtttttggacttagggtggagaacatctgcatttagaattgtgtagaggaaaggttttgatttatttattatacctctgttttctttaaaaaacctgcatgtgtagtaggaattttgccagaggtgggaatgtgagagtcactagtttgcagcatagagcattctatactgagataattatttttatgtcaaaaagaaagtgaagaatctggcagattagaatcttcatgttattttcatttaaaaagcttggaagtgtcaatatcaattaatattgactgctatttactgacatttttggcaaaaaacatttcattttaatgaattttgtcttgtttgaatgtttgtaaggctttggaggtagttttaggagatagttgcctttgattcctgaggtatattcttgggtctaccctgattctgtctcttgactttgcacctctttccttcctgaaccctgtttaaaagagccttccttttacgactcttttcttccatcctattcttccttcccatgctaatgtgagacacagaggtttttatgagaagcctgttgtctatatgctggatcttggaagccttggttatttcctagagatggaaggtctgatctcagttaagttctgaccccaggacaagaagcctctctggagtaactgactcactgggatagagcctgttttcacaaattaatattcctgtctggggagggcagaggaaacattttggggagtgggtggaggtgatgaggttcaagcctgaggatgaagcttgcctttcctgggagcttgtacagtgtcatactcaggaaataaactgtgtgggaaaggtggtgtttagtaatctagagccgaacaccttgtaaggccctcaccttgtcattctgcactgtcagaagcacatgagaaaagagtgtaggctgccagagcaagcatcacaccgaaataggaacttctcagatagagccgtctgcctaaaacaaagtaaccttagcaaataggatctgtgctacagaaaatggagcactctagccagggttgtgagatggagctggtcctggggtcacaggtggtgtcttgggaaacgttctgaagacactcagcttttcggatattgcacagttcattaggagaggtatgggcagtggttatgaagctccttatgtaagagacatagagatacactcaacagtattactccagagggttctggctcctgtcttgcacttgggagtacacacttgttcttgtccacattaacctccaactgtccacatgatcaaccatctgcagacccactgccagttgagggtcgtgccaggtcagaagtactaactgcaggttaaactgtgctatttagaaattgagtgtttttttcttactcaaactgacagttttcctttgtagaagaactcactcagcttccactctggcttaaatatttcctttacatgatcaatattatctctgtccatcagatacagcaatgagaaagccttttaaaggaaatgaggttaaaagtgactgggtatctagaattctttattttgtttgctaaattgcaggcaaatatattcccagaactagttgtgataccttttcagaaactggcttatttgacattggctgaaagtaatactctaacactttactgctgtgtcaatgagtgaaattcctgcaggcaaaaacaatagggactacatcgtgaagcctatgagaattttatggtggaaacatgagtggagcaggtggtggaagtagctcatcttctgtggttgtggtacccacaggagatgagctaaggagaatgccctgaaacctaaccttgccaattttctgtcttctgtgtcctggttccttctggtttccttgtgtctcttttcttccttttaatttaatagtgtttactgaagaccttctgtcttccaagttcaagtattagtcatctctgggctttgcccttagatacttatcatagtctagcaatgaatgtaagcattgaggaagtaatggtgacataatgtgaatgttcagtgtggtatcatcttccccactctttgtaaatcttggtggtcttaattcttgaatgtcaatgcttaccccctctatgctgtctttacagaagtcctctggcctagctctctctacatgtctaaaattgtagaagcatcttctgggcactccattgcaaagtccattctgcagaagcccaccatcccacagaaggagcaggtgggaggcagtggaccacaggctggctgcatggtagcaattgaaaagcaatggagcacaggctggcttcatggtaacagttgaaaagcaatggagcacaggctggcttaattgtagcaattgaaaggcaagcttcatctcatcagctggagtgtttactacttgaggatgggtacttgattggtgtatctttacattttatcaaaatgggtttcaccttggaagcattcagtggtacctcagtgaataattgtaattagctaggatttctttggggaatacttattgttctaaatttatatgtgtttacatatatgtactgtattagtcttttttcacactgctgataaagacataccggagactgggtaatttataaagaaaaagagatttaatggactcacagttccatgtggttggggaggcttcacaattatggcaaaaggcaaggtaagaacaaaggcatgtcttacatggcggaaggcaaaaagagagagcttgttcaggggaactcctcattataaaaccatcagatctcatgagacttactatcacgagaacagtatgggggaaactgccctcttgattcagttatctcccacagggtccctctccctatacgtgggaattatgggagctacaattcaagatgagatttgtgtggggacacagtcaaaccatatcacatacatatgcatatctttatgtaaggtgtgtgaatataggtgtgtatattcatatactcttgtactttctcaaacacaaaccatagcacgtgcaataatatccttgagttacatctgctactctgcccattttacacataagagatggaagcattgatggttatattaggtagggttctctagaggaacagaactaataggacagatagatatataaaggggagtttatcaagtagtatttgttcacacgatcacaaggtcccacaacaggccatctgcaagctgaggagcaaggaagccagtccgaatcccaaagctgaaggacttggagtctgatgtttgagggcaggaagcatctagcacaggagaaagatgtagacttagaggctaagctagtctagtcttttcatgtttttctgtctctgctttatatttgctggcagctgattagatggtgcccacccagattaagggtgggtctgccttccccagccctctgactcaaatattaatctcctttggcaacaccctcagagacacacccaggatcaatactttgcattcttcaatccaatgaagttgacactcagcattaaccatcacaatggtgtatacacccttctctggttgctgatggagttaaagtgagagccaggatttgaatcatagtcataaaactgcacaaaacctctgccccatactacctcccagatacataatacacacatgagtaggtgtttttgtgcctgttatagtgcatttgagcctgttgttcttagtttgctcttatgtaggaccatctctctgaaaacagatgatcagcatcatatgcaacaggtagtattgattatctgtagcataaaggcatggaacacgggattttcagggaatggagtaggaaaaattcctgaacctaagcagcttaatagtttaatatttcacttggttagttcgaatatatatgttcatatgcacatgcatgaaatgacatggataaaataagttttaatgtattgtatctatataaatctctttaaacctcaaaaaatgtatatatccaaactaattatttgtcagtctctccctctctttctccctctctctctttccacgtatttatatataaatatttctgcaaactaaccaactgaaatattaagctcctatctatgttttatatgtatttctgcaaatagccaaccaaaatattaaagcaattaaactcctaaatataatatttcttttatctattatattatttcttcaaactaaccaattgaaatattaagcttctatgttttatatatataaagtatttctccaaataaccaagcaaaatattgaggtattaagctcctgtgaatgttttatattattctatgtatatagaataatatattttatatgttttttattatattttatattattctatatgtagaataatatattttatatcctatattatatatagaataatatattttatatcctatattatatatagaataatatattatatatcctatattatatatagaataatatattttatatcctatattatatatagaataatatattttatatcctatataatatatagaataatatattttatatcctatataatatatagaataatatattttatatcctatataatatatagaataatatattttatatcctatataatatatagaataatatattttatatcctatataatatatagaataatatattttatatcctatataatatatagaataatatattttatatcctatattatatatagaataatatattttatatcctatattatatatagaataatatattttatatcctatattatatatagaataatatattttatatcctatattatatatagaataatatattttatttatattttatttttataatatattttgtaatatatatgttttttatatatagaataatatattttatattattctctctctatatatagcaggttagtttgaagatatctatacgtataatatattaaaatttatttttggccaggcgcgttggctcacgcctgtaatcccagcactctgggaggccaaggcgggcggataatgaggtcaggagttcaagactagcctggccaatatggtgaaaccctgtctctactaaaaatacaaaaaattagctgggcatgggggcatatgcttgtagtcctggctactcaggaggctgaggcaagataatccgggaggcagaagttgtagtgagccgagatctcaccactgcactccagcctgggtgacagagtgaaactctgtctcaaaaaaaaaaaaaattattttatagatataatttcatatatgataagttaaagtacaaactcttgaaacaactcctcttatatatgaggggaaagaagaagattatttgtacagtacaattagtacagtgaattctgggaaaaagtcagtaaatactcatttcaaatcctcatgtacaattcaagtaaagaaaaatctggtggcatttttatatcctgctaataaaggttatctggtgttggaaaacatattttatttttacatgtacatagtaggtgtatatatttgtgggtacatgagatattttgatataggcatatgtgtaaaaatcacattagaataaatggagtatacatcacctgaagcatttatcatttctttgtgttacagactttccaattatgcttttagttatttaaaaatatacagtaaattaatgttgactgcagtcaccctgttgtgctatcaaatactagatcttattcattctgtctatatttttgtgcccattaaccatcctcacttctctctctctcccattacccttcccagcctctggtagccatcattctactctctgtctccctgactgcaactgaaagaaatatttttaaagaataggctggaaggccacactgactctcactgtttctggcacactaaaccttgccattttctgcagtagggattgtctcgcttcagttatgccttgctacttcagtgaaggactttctgttcccactgggctcctatactgagtctgctttggagataatagtctgagatgtcagagcgtcttagtggtgaaagcaacttaagaggtcactggcacaagccctcgttttgcagtggagggagttgatggcgagggcacttggctaattagtgaccagggctatagcaggctcaggttccatgactgtgcttaccatggctggcaggatcccagggcttttctgtgtaatatgtgggtggatggtctattgccttgggcttgtcgcataatcatggagaaaacagtttatattttcccttcaatttttaaatccaagatagtttgatagcacatgggaaaataaagtcattgagtaaaacttatacggatgagaatcttttgattaaattttcattgtaaaataatcatagtcataaaaagtgtatcaaaatgtgtatttggatattcattttaaagagtaaaaaataatcagatacatagtattgtacccactgacagacaaggaaagagaacattcccactgtttttatatatcagtgtgagttgcttccctctctcctacctttcagtgaaatctaatcccccaagatttggttttcatactgtccttgctgtatatttcaggacaaacatagctctgagcaatatattgtttagttttactattatgtaaataaaatcacactatttgtagtcttctgtgacttgccttttatgtttgagattttcccattttcctccatatatctgtattttattcatttttgactgttttgtaaagccttctgttttaatatgccaacatttatttattcattatcctatttatggatatctggattgtggcaatattttttgcaattataattggggcttatttatcctcagcaaactaacgcaggaacagaaaaccaaacaccgcatgttctcactcataagtgggagctgaatgatgagaacacatggacacatgggggagggaaacaacacacagttgggcctgtctggggatgcccggaggggagagcatcaggaagactagctaatagatgctgggcttaatacataggtgatgggttgatttgtgcagcaaaccaccatggcacatgtttacctatgtcacaaacctgcacatcctgcacatgtaccttggaacttaaaagttgaagaaaaaaaaatggggctgcagtggacatttccgtgcatgtttcctgatgcatgggagttctagttgctccacatcgttgctcagtacttggtatcattgtttgtttgtatttttattaatcctattgtgatttcatctgcatttcaccaataatgaatgacattgagcctcttgtcctatgttgaggctatctgtagatttgaggactccttcctggatgtggatttatggtggagaaaccaacaaagatggctttgagtgtaggctgaattactagaaaagtaatgatctagttatccaaatatgaaacaaaagcatggaagcagtttggggattggagaatgagatttttaggagcaccataagatgtctatctgactatattcttgaagagaaaatagtcatggcactacaggcatggtggcacataccatgttatcagctggcactacaggtgtatgcctccatgaccttgaggacatatgactttgagttcggtgagagagatgaacacaaagcctagagagatctgcaaatcatttgatttagatttagaaattgtgtctggaaaacatttaatttcacacagaaaatcaagcattaacgcacttttattatttgccagtccttgtgctagctttagatatgcagaagatgaataagaagaaaaaatgcatcacaggtagggatagataccttcatgagaatgtaagctcctagtgggcaggaactccttctttaccccattacgtacccttacctagcatagtgatctttacgggatacttctgtggtctgaaggcttgtgtctttccagaatccccatgttgacgttgtaaccccaaagtgatggtgctaggaggtagggcctttggagctgatgagatcatgagggtggatgccccagaatggtattaatgacattttaaaagataccccagggagattccttgcccttttccccttttccaaagttataaggaaaatacagccctctaggaagcaggccctcaccatacactgaatctaccatgccttgatcttggacttccagcctccagagctgtgagcaatgaatatctgtggtttataagccccccaagctatgatattttgttacagcagcctgaatggactaagccaacttctaagttttggtgttgtcttatttctttggtcggtgtaggatctttctgtccacatagtttactctagaaagatgtatgccctattcctcatggtatatttgtctttcctatctgtggaatatcctcttatccaattcgtcttggctgggcaacatataagccattaactctttacccttgggtttagtttgggttctgctgaggcccctgctgaaaattctggtttctacaattatggctcatgcatgttcctgacccattaaacttcagtggaagaacagaaatggtgagggaggtgatggagttgataccttgagctgccatatggtgcaagatcatcttgaagatagaacatttggcatcctttttttttttaagagatggggtcttgctaatttgcccaggctaaactcaaactcctgggctcaagtgatgctcctggctcagcctcccaattacctggcaatacaggcatgtgccaccatgcctggccacatttttactctccaattgcttaatatatagtaaagataatggttcaaaatggtaaattttttttgtgtgtataccaataacatttttttttaccttaaacatattcaatctttatttgacaattttttaaaatttcaactttttttttttattcatgggatatatctgcaggattttttacctgggtgtattggatggtgctgaggtttgaggtacagttgattctgccacacaggtatggagtatagcacccaacaggtagtttttctaccttttccccctccctctccctgctgtagtagtcccaagtttgttattgctttatgtccatgagtacccaatgtttagctcccacttctaagtgagaacatgtggtatttgattttctgtttctgcattaattaacttaaaataatggcttccagctgcatccatgttgctgcaaaggacatgatttcatttgtttttttttgtttgtttgttttgtttttttgagacggagtctcgctctgttgcccaggctggagtgcagtggcgcgatcttggctcactgcaagctccgcctcctgggttcacgctattctcctgcctcagcctcctgagtagctgggactacaggtgcccgccaccacgcccagctaattttttgtatttttagtagagatggggtttcactgtgttagccaggatggtctcgatctcctgacctcgtgatccacctgcctcggcctcccaaagtgctgggattacaggcgtgagccaccgcgccggctgatttgtttttatggctgcatagtattccgtggtatatacgcatcacattttctttattcaatctactgttgatggactcttagattgattccatgtctttgctattgtgaatagtgctgtgatgagcatacatgtgcatgtgtctttttggtagaacaatttattttcctttgtatatatacccagtaatgtgattgctaggtcaaatggtagttcctcttttaagttccttgagaaatctccatactgctttacacaatggctgaactaattgacgttctcaccaacggtgtatatagccttctcttttctctgcagccgcaacagcatctgttgttttttgatgttttatgaatagccattctgactagtgtgagatggtatctcattgtggttttgacttgcatttctctggtgaaaaatggtggatttttaaatgggatttcatttttagatttaatagaaactgcataggtgactgtgcaaagaactcttaagatttgacaaaaggcaaattagattgtaatctcctttatgtaggaggggaaataaaaaccagaatattaaaatatctacatgtacaaaaatagacaaagtggcagattgctggtgttggatggatgttgagcagggatggaggacttgtgtgtgcatgcatgcatggccatgcgtggagagtggtcattcattttggtaacagcatagagctttgggcttcagaacaaaagataagccacatcccactcaggtaccctaaaatgttgtctccactagacacaaaagaaaaggaagccagagatgtctgtagcttatgcagagttttgggaatagctattctagactttcttagtgaacagtatagaaggattattgtacaagcccagtaatttgggcaaggatcagattctgttgcttttgttttctggatgctccgtaatgaatgtgagatggaagcggatgtctcaagtgcttcttgttctcagaaacctcctggcagcagacatctcagtgggcccagacgttcagcgtggctggaagtaaaacacagggaagggtgctctttctcagttatcctatttttttttaaaagcatctacaaagcttcctgttttctaatatattcccaggcctttgaaagacaaggccataaacacccaggagatgtgactttattctttttaaggtccagataccaaaatgcctgtcatcagggctcaccttaattaaatacgtatcttaaaattaaaccaatctcaatttaaggaatgtatactttggggagaaatttattacaatttttattcagaacactttaaattctgataggcctgaagagtgtgagcctcaccttaattgcaacctgagtcagaataactgccctgcagagaatcatttaaaatacccaatcaagttataaattagtcaaaatgccattctgagatattattattttatgcagtctttgcagagaatacatgctatatagcccttcttcactcccaaagtatatgtatatatttaatgaagttttcaccttttttattaaaatttttaatccattaacaattttagaattcattttgtagcatatcctctttatcttagagatattaaatatctacctatttatgaataactatcaataaccacgtttcaccctttgtgaaatccttttcagtttttgaaactcacatgggagatcttgtttttttttttccccacaaggatgtaggttggttaaatttacagtggttctttaatgatgataatgcacatttgattgatatcaataataaatattgatatcttcaatatcaacatttcttgtaatgctaaaaatttacaagttgccaattttttgaatatgactatattttcacacacacacacatacacgacagcactaattatattcactaaatatacctacagatacttaatcatttacacagccactataattttatacttgatgccttaaaccagtaattctcccttgagggtggttttggcccctgggctacctagcactatctagagacattttccatagttaaaactgggtaggaggtgccactatcatctagtgagtagaggtcagggatgctgcaaaatactgtacattgtacaggcgacgcccccacaacaaagaattatatggttcacaatgtcatttatactgagatggggaaacgctgggctttaattatagcaattttgtgcaaattagccaaatttcaaaaaacaagggagtgaaaaaagatagctctcaacctgtgaatattgtgaatgcccaatctagacctagtaagtgtacagatgcccttgggcgcgtcttcttaggttgctgctgcttcataatcgctcactgcccatcaggaccttgtgggatgtagatttaggcagaggagggttttgatcatacagctggatcagtcataaccaataagtgactcatagtctcattcacattgagtttgagaatttaaggtgtgggctggaattccttatggaactaactttatataccttggaagaagtccacccactgaattctacatttattgagctctgtgtttcagggaatgtgcaataccttgaggatacatactatctcatttagtcccaagtagcttttaaatatttgagagtggttttggcccccaggctgaaagtaacagctacctctggttaaaaatctttcaggaaagaagcaaccaaacaggacatcacctctttgtttttcttgtctgtctcttaattattcagaaatgggattgctgtatggcagacatccaaatgttgtctacagtagaattcagagatagaagcaaacacctaaatcagtcattggtgagatgctatttgtcactttcaaagttataatccagattttcagtgcgttttcatccaactctggtgaacttttcccaggatgtcatgtactatggaatttccccccattgtattattgttctgtgatagatccagctccaatatgttttatttaaaaaaaaaaagccatgtgatgtattctgttcaactgattacttaaatgaaatggataattattttctgatgcagatgctctgaataacccacaaaatccttagaaacacatttgtatattttgagttgaagaacatgctaaaggcaccctccttgcaacacctagtgaaatattttctgttcctaggggatcatttaacaacataatgtccattcctgcacagcattcttttattgtcacaggagcagcgacttatgtagggatagttatattatctatgtaaagacaaattgaggtggtgaccctttaaaagttgactccaggctcaatgggaaagtaactcaaatgcagcctcagctttttaaatgggctgaagggtgaagaggataccctctaaggcatgcagtggcttactggaaagtcaggataattgtatcaacacttttaattatgaatgaagtcttcaagaaactagcactacagcatgtacttgaaatgcaccatcttgtatagtgttttacaaggaaactgagattcagagcagtgaagtgtgtagcctaaatatatatgcacttgaccagaccaaggagaatttgtgtccaaagtctacactcttttcatttgatgatgttccctttgtggcctgataaatatccacatcatgatgccagattgacttggatgcatgcttccatctttctcctactggaaaacttttagagctccatgcatgtctccttaggaaaatgtgacaatttccttaaacatttgagaaacagtgttttggaagtacccatgtattgataaccagtctggtaaacaatagcaaaactgggaggtgttgttactataatctgcataacctgtataactcttgaacatctgtttgatcattcaacacagatttgtttagtgttttctaaatgtcaggcattgttcatggtgataggatgtacagaggaattaagacaagtggtggctgctaggcatggtgactcatgcctgtaatcccaacactttgaaaggtcgaggggtaggatcccttgaggccagcctggacaacatagggtgacccaatgtctacaaaaaaatccaacgaattagccggacatagtggtgcatgcttgtggtcccagctactcgggagggtgaggcgggaggatgggttgagcccaggagttggaggctgcagtgagctatgacagcaccactgcactgcagcttgggcaatatagcaagacaccatctctaaaaaaaacaaaataaataaagacaggtgatgttcttgctgttgcctactatgtggagatggcactatacacatttctatacaaatgaataggaatttcatagagagatgttgtggatttcgtggaagagccagccagtgttctaggtggtcgttgtgtggcttcattattcttgtctgctttcttcctcttttaggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatggtgagtacctcactggaacagaaaacaatacctcttgtgcagtgtgtagagagatttgctaggagggttttataatgtctcatgcatgatctcttctataacccgtttattttattttaatttatttttcatattccaaatgcaattcttgcagcaacttaccacatgttccacttgtatgtattgggccatctactgactggacaaaactataaataataactttaattattttcatatattgccttcttaactttttataatgcttatttgcagatgaaaataaatatgagcatataatgttgcatgttatacctgaatcatctgtaaaggaatgaatctatagaaaaataatagaattaagtacactattatgctccagtttgcaaactgaaagatagagaaaatggttctttctgccttaatgacttaagatattagcaccttttttgagttttcaaagaaaaacttgattgtttttaatatacaagtaggggatagttcatacaatggttggatttcattgtttagaatcggttttcttaacgtaaatttggatgttcttttcttccaatattcgctgcaatcaagtggcaaaatgtaatcagatgattctagctacattagagatgaatgcgtttgtatttttaaaaatttccttttttatataaaacaacaatgaaagtctgtagacacaataacgtttaatatattaacctaatgttagtaaaacatgaatagttttatgtctgtatagatttcaaattcagatttccttggaagaataaccagactaaagtatgccataatggtatcacatttcccagttagcatttccatatgccgtttttagatgaggagaaagaacaacagagaataaaatatacctggaaagaaaggaagttaatttgtgggaatgatagatgtatctaatgtagaaactagagtgtgtcctttgtataaagttcttcgtggaaagtgtgataaatttcttttatggagaaatttcttcttcttctttttttttttttttaaacttcaatccctggaaaacatttttcagtaagatttggctgaaaatagtaaatcaacaacgacgttaatccactgatctccaaaattgttttgcatctatcagattactctttctccatataaatgccagatagtttaagtagagtgtcatgaaaaaccataccagggttgtgtgtcactgaggttacaaattgtcattgagattacaaagaacagcccagagaaagaaattaaaggattctgcttcattatattagtggtttctggcatattgcccttgtcgttatggtgacagacctctcaattatctcataaagtccaggtctgaatgtgattcaaggagttaaactgacatttggacgctgtacttccatggggtgttctgagctgtctccgtgcctaacagtccctctttgtgtgtgtgtgtgagatgaataagagctctcaaaagcaattagggttctcatttgagcagccacctgggttgagatctttctcataatgaactattcaaacaaaaaccaaaaagaaaggaagacaaaaatggggagaaaaccccccaaacaggacaaagggttaaaattgctttcataatactttggatgtgctagagtctggtgattttgtagagctagccttggcaacaatgaatgcacttcaaatagaaggcctcctcatataggagttggacagaatgagaccacccatgaaaaagaatcaatagcctccctgactgcagagccctgtatgtacaattgtgtggatggagaccacaaacggtgtggccgtttcattgcaattcggtattgaattaaaatttgaggaatgtaaatatgtgaaaaatgctattcagtgaaaaagtaatccaaacttcataataaacccagttccacttgtttagatctttaggctttttgaagcaatatgtgcatatgatcttgacaagggaatcagaaatctaatagtgactgaaaaggtagaatcgatctccccacgatgtgtaaactttagaattttgctggtgagagttcaaagctacagccctgcatgtttgtaccatccacaagtcacagcctattgggttaggagtttttatttttggttgcttgcttgttttcttaactctatcaacgaagaaccagtgcaggccaggcgcggtggctcacgcctgtaatcccagtactttgggaggccgaggcaggcagatcacgtggttaggagatcgagaccatcctggccaacatggtgaaaccccatctctactaaaaatacaaaaattagctgggcatggtggcgcgtgtctgtaatcccagctactcaggaggctgaggcaggagaattgcttgaaccaaggaggtggaggttgcagtgagccacaatcgcgccattgcactccagcctggcaacatagcaagactccgtctcaaaaaaaaacaaaaacaaaaaaagaaccaatgcagagctttagatgtttaattattaattattcactaaatgaatgaactccgcatccacaacatattgaaatgttggcatcatgctgattctctccaaaggccttctcttagggagtatctcagttcagatcaatgcttttatttagcaggagagagagcaatattattatttggaattcaaaattccactctgaccagtctgacaaagccagaaagacaaatctaaacaataacaacagcaaaaatctactttttttgtttagctttgtctttctgccttgatcagattggctcaaatttctatgtttctactttcataaaatgtgtaggtatattaaaaatacaaaaatagactattttagatacgtacttatccttacatttaagaactaacttgcatgaggaaaagtgttggaaatttcttcgtagtacaatagtttatgaaacatatattttttttctgtagaaaacaatactttttataattccctttaaaataaatcaggtcttgctgaaggtgagtcttttcatttaaactggcatcatgatctactaaacttaggcttgggtctttataactatttcctaccttacaaatttctttatttaaattttcataggttattaatttctctttgttgttagacaacaggctaattaattaacttgaattgcatatttaaccttttgataggtgctcaaataaggtcaaagtcagtcaagccagtcggaagctctagtaggacacgtgggccattgttgacaaggaacagttggagaccgattgaccgaatctgcatggtgtgtgtgtgtgtgtgtatgtgacagagagagagagagagagagatagcagagagagtgtgactgagtgactactttgaggaagcaatgcagaatatggcttggtagcttgattaaacataaattgtgaaagtcaagccgagaagttccagtctcacatactaagtccacttgagttcatacatgaggggatggcagtacagttcgtgattcgtcttggtccccaaggagactgaacacagaaagatgagttatggaaacacttaaggtttttaatgagaaccagtgatactgtttagaagtgaggttaaaaagtaagggaaaaataaaagacacattttgaaggagttgctcagacaagatatcatattaaatataaagcttggaggagaaagagccacaagtgagtccagattgccttgggaaatggacagacccatggaaccacttcctgagtgacctacacctgtgctttttctctggatccttggacatacatcttaaggtcttattcttgaaagatttcaggggcgagaagcccttccattcttcatcatgggactaaaaatactgggaaatataaaggaaaatataaatgaaagtcattatcgcccaggcacagtggctcatgcctctaatccgagcactttgggaggtcatggtgggtggatcacttgaggtcaggaattcgtgaccagcctggccaatatggtgaaaccccgtctttactacaaatacaaaaaattagctgggcatggtggtgtgcgcctgtaatctcagctacttaggaggctgaggcaggagaatgacctgaactcgagaggtggagggaggttgcagtgagccgagatcgcaccactgcactccagcctgggcaacagagtgagaatccctctcaaaacaaaacaaagcaccactcattatcattgtattttcattgtagcataacagcaaatgccattatgatttctagaaaagtgaaattttgggttgttttttttttttgctagcaatacaattgaaaaaggaagatattaaaaaagaacagattattggatgcaaggtgtccctatcatctttttcccccaagatgacacctgactctttgaatactatgacttaagtaagcttgctatgattgttgattgaggacctatttggtgaaaacatggagctttatgatgaaatataaacagacacgacatggacaatgacctgtaggagtttgcacagttaataaacctagaggtagataataagccagagcatcctagttagggaacaaagaaagctctgtgacagctcagggacaggctattttttgaggaaaaacttgatggaagctgttaagttgttgagctgtgccatgaagaatatatgggtgatggaagggattcatctattaaagcatctgatgaatggaacatttgaacacagaaatctatgttaagcagtttggtgtcaatcgttgctgttgttactacttgggtgttaagtgtggcgtggtaacagaagctgtgctttagcatgggctgtttctggcagtgccatatcatgaaagttcttttttttttttttttccttttagaaacaggatcttgctctgtcatccagggtgaagtacaatggtgcactcatagctccctgcagcctcaacctcctgggctcaagggatccttccatctcagcttcctgagtagctgggactacaggtgcactccaccatacctggctaatctttttagtttctgtagagatggggtgtcactatgttgctctggctggtcttgggttcaagtgatcctcccacctcggcctcccaaaatgctggcattaccagcataagccattgcactgggcccataaacttttttatgttatccacagctgctgaccctatactttctagggtagacaagctacctaagatgaaagggtggcaggagaacaacagggaaagaagctggaaagtcaaccagctttgctagcgattttacaaaaaaaaaatgtattcgcttcttttatagataccactggatctaattcaagatataatttatagcatggttttcatccttgaatagctcccatcttttctgagggtcttacaaacttttctggcattctgcattagtcaagagatatttgtgttcaaatggtagaaggcaacctagcctcaatctgactttgagggaaaaaatggaaatttattagaagggctatgggatatccaaacttactgtaaaagttgagaaatcagattggcagaatggcagggatgcagctagactttagacacacctggaagcattgaatccaaggacatcaccaatcttcatatctcgttctttgcttctttctggaaataggcttgctttaaatggcagtaagagggttctctgcagtttttgttagttgcattttgtttttctcagtaccaccagtgagggacaaagttccataattccatactaaaaatcccagggcggggttttgattggcccacttgactcaggagtaagaagagataaaactgggctgttcttgtgtataccagttggcagggggagaaggacagttctcaccataaggtgtctggaatgagcaggcactacttcacttcactgtccaaaatatttttgagcatcgattatatgccagacatgccttagaggctgagattgtgagagatacaagcattcctaattttgagagataggtacttgtaggcagaaaagtcatggtccctgagagatgtgcaagcaccgccctccacccctaccccccagccaactcgcccattcctggaacctgggaataggttggaggcatggcacctgacttcttcaatactctgccttaaataatgacttcaaatggcaaaggggaattaaggttgccgattgaattaggtttgctaatcagcagaccttccaatagggagaatctatcctggattctcatatatattaacagagaccctccactgtggatgcagaagactcaaaaggagatcagagttggtgtaaagcaacgtgagaaagagatacctggacattgctggctttgaatatgagagagccaggagaaaggaacgcaggtggcagtctctagaagccggaagagacagggaaacagatttttccttagagcttccagcaaggagcccgacagccctcctgataccttgattctagccccatggaagaaactctgaccttagaactgtaaaagaataaatgtgtgctgttctaagcttactaagtttgtggagatttgtcttagtggtaatagaaaactaaggaagagttttatcaccctgtaatattatttgaaattcataatgaagtattactctgaaaacaaaagttcagagtctctgaagttgtttggtttcgggccttctggacccctctccattctgggattctacttccaagaatttctagttgaaaacacccttgggcacttagagctttctaccttgctcaagcatgctaaggagatcatatcaattcttattttagggcagacatttttcagatttttaaaaatgtattttttaaaaatttgagagataggtaccctgtctctgaatggggtcttgcactgtggcccatgctgcagtgcagtgtcacagtcatagctcactgcagcctcgaactcctggccgcaagtgatcccccaacttcagcctcctgagtgtctgggactataggctgagactactatattgaggttcagagaagaagcatgtccaggtgtctgcaaattagaaaatggtggcagattttttaaaaaagaaacgatgaaaaattatccctgattagatttacattacaattttcagccaccatgactggctagtttttaaatttttaaagagttggagccttcctatgttgcccagactggtctggaaccctagcctcaagtgatcctttcatctcaaactccagagttctgggattacaggtgtgagccaccacgcccagtgacattttgcaaatttgacattttgcatcatgttaatatagcctcatggccaattgtcctaaatggtatattcaaaagataatactgttttgacacagaaaggtaccaaagggtcatttagaattttttcaggaagctataacagatttccagagtagatggctttgaatgacatataacaaaataccgaaattgttctttcctcatctgtctccacagagtttcactcaagatcgcggctgcacctttacatgtcttattttcctacttacaaacactgctgacaaaatcctctgtgttccccactccttccggctacaccttaagctgtggtctcttctgggcaaagtgattctctgaccttttcaagctacaccttgtttcctcctccaaccaaaacttgtttgctggagttgaaatgccagtttagccccttagcagatcagtcattatgggcaagtgacccagcttgcttgggccacagtgtccttatgtctaaaatagaggcggctgagaggtttaaggttttaatccatataaagtgcttagtagccagcacgtacaagcaccctgtaatctgatgttagtgcagcatcattaataacagaaaagggaacccgaaaatttcagcaaaattgcatgtgcatagtgggtctggtatgtatattagtctaggcataataaatgttgaacgtctgtgacataactattgtagtagtagaggggtaagcttaagaagtaagaccaataaatagcccatcatttctggcagtttctagtatggttttaacaaaagggaattttgggaggaataacatttttaaaaagagcccactattatcattctgctttattcctaactttagtccttttgagcctgtgttatcaaatggattttgagcatatgtgaattagagaaattaatcactaggaaaggattagaattaacttttttggaaaagttccttaaaccgtgaaaaggcagtaacaccattctttgtgtgtgagattaaagagaaattaattttctttctcttcttgtctagacacacaaagtccaattgtacgcatacagtcacaaaatataggtgaaaaacgaaaactgtgttaacacggtgagacagatgttttaaccaatcaacatcaacatgcaactaggtgaaaataattaaattactccagttttcatctgtcagttggatgtttgacattgtgtagacacagcttataagtaaagataattatgaaagattattaaataaagatctccctgacacggattaattgaaaagtatttagtattttttgtaagcacagttaaactggagtggatttccgatagcatgtgtctctcccccagctcaaaaagctttcagcaatttgaatactgagtaataatcttattgagggtttagaaattacatatgtttggaataatactatttagtagtatgaattatgcctgtttgaataattaagaaatatcttttcctaacaaagaacattttcccttatgtacataatcttccaatacatgaattttaattcaattcaatttgcaatttagattcttgtcataatttgaacaaatacagattacctagaatatattaaaaatcaaattttcacatagtgcatatcataagaatttttttttagaaattgtcagagatagaaactttaggtacaactagtccactggaatatttggccatttaaaacaattagctcattatttatttgtggagtcttgcttcctaagatgttgtagtcttatttgttgtcaattaatattgctggtttgaacatggttatttattttccgtactattttagccaagctattaatttttattatttatttttttaattttattttttttatgtttgagacagtcttgctctgtcacccaggctggagtgcagtggtatgatctctgctcactgcagcctccacctcccaggttcaagtgattctcctgcctcagcctgccgagtacctgggactataggtgcccaccaccacacccaggtaatttttgtatttttagtagagatagggtttcaccatgttagccaggctcaaactcctgacctcaggtgatcctcctgccttggcctcccaaagtgctgggattacaggtgtgagccaccgtgcctggcctagccaagccatttaacctttaaatatttagtgtcctcagctattaaaaataagagtaatatgattatacatcctatgaatttgttttataattattgtgatttgggagtaaacaactatataagaaataattataaaagagataagattagtgcatattaagactttgatgtcaggttaattgaatgttaatcccatgactttatctttcattgcaagattctttgcctgagtggggtactggaagccattgttgagagtagatccgatcttactagactgttggctggttctcctaaaaccaggctgttttcataatgagttagtttaacattttgtctttatgtttaagcacccctttccttggtgcagtcacagccaaactgcaaacagaaatcgagaagttgtgagctccagatttgagagccacagagagtttgtgagatcaaaaacatccactctcagtaaataaatcagagctacctaaatcacacagtcagcttaaaggcaagggaaccagagggaaaaactccaaaggagtgatctcttcatgcaattgctactggtaaaataaagcaaagatgagacagtgtagtctccaccttattatttcaatctaatattctatattgaggttcagagaagcaggtccagatttccacaaattagaaagtggtggcttgctcttgtaatcctagcacttggggaggtctaggtgggtggattgcttgagcccaggagttaagaccagcctgggcaacatgacaaaaccctgtccttaccagaaaaaaaaaaaattagctgggcatggtggtgctggcctgtagtcccagctacttgaggggatgaggcgggaggatcacttgtgcttgggagatcaaggctatggtgagctgagatcacagcagtgcactccagcctgggtgacacagtgagaccctgtatctaaaaaagaaataaaagagaaacatttccttgttagactttacgtatctgacgatgacttttgatggtgaaggtaggcattggtatgtggtctgtggtgtgtgtgtgtgtgtgtgtgtgtgtgtgtgtgtgtgtgtgtctgtgtgtgaatgctattgaaggaaacccggtaggagaaatatccacaattcagttaagatcaaacatgttacaattttctgggaagtgccaagttttacaacacctaaactatatcctcttcctctctgaaaccccaaacatcccaaagtctccttcaagccagacatcctcttggtctactgtgcatggtgtctgcacggtcctcaagtttgcctcagggaaagtgcctgttgccatcagaaagaaagaatgcagcaggtactgatttatctcaggcaaaggagctcttgtggtgggtttcaacaagatatgaaaattgtaggttcttgaacactccttttcttcttccttaaaatggatgtctttagctacattctactctcttctctgtcttttatgacataatcagtcattcactcaacaagggaacatctaatattcacctaacatcccatttgcctgtcacatatggactttagcctccagtcgggccaatgacactattgatctcctaattccaatctagactctttgggtatttttttctcttttccattccttattttctttagaggcattttagataactcatttaaaaattattagtaaataaatcattatttgcaatcagcatagacaaggccttgggtgagtctaagtggatatctggagagatctaaacccgctgctggaaaagtgagtgggaaagccccattgatatgtgacccaactaaaccaacgtttcatcaaaagcagtgtcttcagggactgctttaggatttcagggaaaagaaaatggaggcaaatctgaaagtggatgttttctatggaggatccttgatagaaaagttttcacccagccttgagtgaatatgcagagcgtaaacacatgtttgtgcagtgaggaaatgctgtctatgtttcctaaaatggaagttcttgtttattgcttctttagctgcacggagacataaaagatgcaaaactggggagaagggagagataaaactaagacaaaactggaggagggtgcaatgatgttgtaatttaacatgcaaaatactcacttgggtattttttaaattgttacattgtgacattggagggttcataaatggaattccatccaaactaattctaatgcctatcttttctttttagcagactatagaataaagttaaatcaaagaacatgaggtcccattcttaccaaattcaaatatactttttatcacctggtgtttaaatcattaatacaaaagctttcagtctcctccaaatttctattctagtaaagtactttcataattttatattggaaatgtactaatccagataactagtatgaaatcaagttataatactattttgcatgtttctaaaatgtttacatttaaaaatagagaagtaagccttagggagaaaacttcagctttcccaagaatattaaaatgttaacaaattatttcattttgagctaaaatcagataataatgagaacaaatttcaccatcgcacattctacagggatctttgcattttatacttttttttttgttttgctttataagaggggattttggtatattgaatatcatactggaaatttacctggacggaaacgatagagtcaacttagactttaatcacagaatgataacatcttccaaggagaaggagcttttgaggtcatttcaccaaaactctttcaccatacagtattttcccgttcattaaccttttggcactctaagcagagatgaagtatcctcccctgagttcctagaagttgaatttaatcaccattttacgagtctgccctccccagtagatggtaaaccctttgaagacccagagcatttttgagataaaagaatgaatcatatacttcagtacatggaacaaatgaataaacctgtagtgcctggccacccagctttttttttgaacctgaccgataaagacgtttacagctttttaatttcattatcagagaaagggttggcaatatttacctgagcactctctacaaacagagatgaagaaatttggaatgtttcctttctctcctaatacatagctttggaagtcttagaaaacatgttggtatgttccttctaggtagtcttttgcaagcatcctcttcagtgtcaagcatctattctcatgcatcacattacaggttatgaatatacccagagtttatgtgagatctttttttgtcaaatgcattaaacccttggcttatatatattgagctggaagccacaagtttttgtaatattttaaaagtaatatattttataatatgccttagaaattaaaaagaaaatagaatacctccacttcctatgacaaaatgtcagcatatacagcaaggcaaagccatttgttgctgaagctcagtttttcccaccggatgctgaatgcacaacaatcaccagccaagccaggagtctgtttactgcacgtttccctgaaatgccaagcccctgaggtgttacaaggagggaaggcagcatacatgtgtgatagaatggccaataaactaattggtttatagttttgagaaagcagctggttgcctgtttttaaatgcagtggtctataatttgatagaatgcagaaggaatcatttccaagaaattaattaaagttcataggttggaaaataatggagctcatcattagggaaagcttattctaagacttaggataaaatgagcttcctcttgcatttcattcaacttaaggttttgtagttacttgtcatcatcaaaaatatcatcagagtcatcgccatcatcattatctaaatttgagtagctatgagaaggtattgtgaggtcctagctttagaggaatcaatttctttgagatttgatattgttattttaagactgcagagcataggttagaatctgtgttttaaaaactttgacaggccacgtcataggtagtaaagttttctcttggcatgagttttgagttgacttgtgttatggttgaattgtgtctctcaaaaaaattgtttatgtcttaactcctggtgcctaggaatttcaccttatttgaaaataggatttctgcaaatgtaatcaaggtaagatgagttcatactgtgttagggaagatcctaaacccaatataattggtgttcttgtaagaagagacacaacaacaaagacagaaacagggagaacaccatgtgaggatggaagcaaacgttgaagtgattcatccctaagccagggagcactgttggaaaccaccaggaaccaagaacaactcaatccaagacagaagcatgaaatggattttctttaagagcctctagaaggaatcatcttaattttggactctgccccagaacagtgagacaatgcgttcttgtttcaagtcaccaagtttgtggtaattagttacaaagccccagaaatgaatgcagtctggattaggtatattctgcgtacatatgctgcctaagaatgccagaagccagaagaggtgatgtctgcatttttggttcctaaaatcctctctcagtacccactgctctgtccagggcaaagctcccctgacacatttttagcctttaggctatgtcctatctcccctgctcaccagagaagtaggtcttggattccagtctctcagggctggcattttccaagtgaaagacactgcctttgtgtaaatccttcccccttgagtgtaggcaggacattggatttgtttgtgtctcatggaatatggtagagataatggaacaccacttccatgattatgttacataagcatataaattgtgtcttactagtataccctttttgttgcattcttggtttccatgctttgatgaaagagcagccatattaaacaggtgcatatggcaagaagctcagagctgcctctgaaacaacagccagcaaggaacagaggctttcagtccagcagtccacagggcattgaatcctgccaacaaccacataagtttggaagcgaaccttcctcagttattcagctttaaaatgagaccccagctcaggccaacaccttcatcagtgagagacttcaaagcagtggaccctgctaaggttgtgcctggattcctgatatgcagaaactcataaaataaatacattacttgaaactgttaagttttggttatttgttacatagcagtcaataactaatgtggcataatatgcaaaacatggatttcagctgagcacagtaatcccagctccttgagaggctgaggtgggaggattgcttgaggtcaggaggtcgaggctgcagtgagctatgatagcaccattgcaatcatagctcatggcagctatgagcctgggagacagagcaagaccttgtttctaaaaaaagacatggatttcaaatttggccagattgtaacccaacttctacatagatattatgtctccattggagggatatatattttgagactttgcaatccttaattacttaggaacaattagttagcaagtgaaagaaattcaggttgaattcacttaagggaaaagaagagattttcgggttccatttactagcggtgcatttagtttcgaaaatggtgtcctcaggtctaatcattgctgttaggaatctggcactttggcgccatgtttcttctttggctttcttagagaggcttgtccgtgtgtggtggtaggcagtcaacagcatttcctagtatgtcatccttttctcagagaagcacattggcctagcaactatgcgtactggcctaattttagttgcatgccaaccaatgtctatatccagtggaaagagatacttgaattgatatggactgcttgggttatgtatactcttcagaaatgagaagagattgggtaagtccagtaggcttagggtagatggaagtaagattgctccccagaggaaaattgaatgctaggtaagcaaaactcattgatgtccattgttgcttatattacaaatagtaccaaacaagaaagaatggcatggctgcttcatggaagaggagatgaacttggggcaaaaccttacctaggatatttccttttttcagctaaaaagaggaacttggacattcagaaatgagaaaacttgtatatcagttgctgttgttgttggtttgtaaacagctgtagctcttagtgacatagagagataaagtgacaggaacagatgaggatatttctattaggatgttatccaggcagttctatgttgggagtcaccctcctgggacactcctgggtctggaagctgtcagctggtggcaaatcagagatagtctgagatttaatgccagatgggaaacgtgacctcaaatgaatgaggctgtttaggagtgggcgcaacatgctgtgcttgccatctcttttaagagttctaactgaaaggttaggtttactgaaggataagccaatttggggagctgatctggtgaacatgaatttggccaaacttcagcctaagcgtttagcagggtgaaagtttgggaagagtttcgttgtagaacattaggcaaatggctgacaaaagagcttccagttctctcacaaggaattcttcaaaaagcaaaggaggtccttctcagtcagcctgctctttctgctcagtagacttctttgtgagactatgctgtgagtgagttctcaggctggtgatataacctggtcttcaattcttgtgcagctctgtaagtccacgtaggcaccactaaatatccttacgacattaagtgtcattggattgtttgctaacatttgcttccatatgggccccaggcattagcaaacatgtagtttattcatttatttattcactcagtgaatatttattgaacttattctaattgtcaggccactttgctaaatgttgttccatcactttccttgcagaacatacaggggaaaatgcacaactaactggaatcatcatttagtgtaatccatgcaatgatgcaacaagttggggagatgtgagaacatctgggagaagcatgtgtcccagactgagagggtgaaaatgcactaaggagaaatttgaagaatcagtaactgaccaaattgctgggaggagagtcatttcagacagacagaggagcacgttcaaggctgaagtccacagcctgacattaatatcgattctcttagctaagttttgttaaagaaaccaaatgacagtgaatttgaagtcctgcactcagccaaccgtatgaagtgtagtcactgtatggtcagttaattacagggcagcatccttcagtcatcagtcgagctagagagaatattgacagatgtgctcttatgaaagctgagaagctcaaccaggacaagtatttagctaaaagggggtctgacctccttttagagatgggaagcaagggtggacagcataacctgtagactaaatctatcacactgctgtttttgtgaagggtttaatggaacacaaataagcccttttatttatgtattgtctatgtctgctttcacactacaaagacgaagttgagtagttgcaaaagagaccatatggcctgcaaagtctacaatatgtactatcttaccctttattttaaaaagttttctgacccctgatgtaaaggaccaacttcatgaagtcgcatgtggattttctagttaccatatagacatgaatggaagagtacagaagttccatgtcagacagcaattgttttcaaacttgctatgaattttttccaaatgcagattcctgggctccatccaggcttccagtgactcaaaatctgggtatagattccaacaatttgccttttagtgaccttagaggtgatattgatggcaaaaattttatatatgtacatattcatgaaacagaaaattggacgtgaaatatttttaatccacatataaacagatactcctttctgtcattaaaaaccaattaggaaaaaatgataaaagcctgattttaaaaccatggtccatatggcttatgcaagataattttctgaagtgaccttcaagatgaaatagttgcaaagtatatctgtgttcagttaaattaggaggtgtgtgtgcaacaaggaattattagccgtagatctttaaaatcaaatcaatgtaaacaaaacactgtcagcccagtggccaaagaacacaatcaatcaaaatatgaataaatatacacaattatacactactactactagatgatgatgatgatggtgatgatgatggttatgatggtgatgatgaggatggtgatggtgatagtgatgatggtgataatgatgatggtggttatcgtgatgacgatggtgatgatggtgatggtgatggttatgatgatgatagcaatgaagataacaattattgtgatgataatttatggcgataataatgattgtggtgatggtctgtttctatgcgtcaatctcagttgctcccccagactccatacaaacagaaccaccttagagatgtttcaaacttaccatgttcgaaactcagctgctgcttttgacacaatgaatgccctcctgtctccatttttaccatcttaggagaactcacaccatcccctcatcactcagtgagccaagtgtgctagctgctgatccacatgtctgaatggccgccttgaggaattgacattaccttggggacctacagggagcaatgatgctggactggggcaaggatgaataaaggagggataagtccaagttgttgggggaagacagggcagccaactctatctggagctctcagatgggtttagcggttgtggagatatttccaatggcattttgaagacgtggaagaatgttattaggcatagcagagattcttaactaagagcaattttggccccactgtaagggacatttgacaatgtctagagatattgttggttgtcacagctggggaggtgctactgacatggagtaggtggtgaccagagatgctgctgaacatggtaaaatgcagaagaacgactcacacagcagagaattatctagtccaaaatatcagtagttctgatattgagaaacttggctctgtattgtgcatgtgtaatcgttttttacttactgattctagattcagctggcaagggggtgtcagcaatgtctggagatattttggattatcccatctgggcagtgtgtgctcctgacatctagaaggcagaggatgctgctaaacatcctacaatgcacagtacagccctcacaacaaacataatcatccagcccccaaatgcccacagtgctgatgttgtgaaaccctgctctaagtcaaagcattgtcttactcaatttttaattcctagtgtatatcagtggttctcaactttggggaggggacaggtttgcttccagtgtacatttggcaatgtgggaagacatttttgtttgttgtgagtatggagtgtgttactgggaatggaggcaagggatgccactagacatcttaacagtgcataggacagcctccacacctcagaatgatctggcccctaatgtgaacagtactgaggtagagaaaacatgaggtagactgtagaagcctatagaagaagagaatctgagaaaattgttgtgcttggggaacactgaagaatgtggagcaattgaacaaatgcttgtgcagacagattggcaccaaattgcaatggagcaccaatgggacagtgaaaagggacaagtcctacaatgcacagttcttgaccatccccaaagtgctccaaagctacagaagttggtgtgcatgtattatctcattgatcctatttgggaattatcatgttgacagctggagtcccatgaaggaacatttttaagcagcaaagtgacaagctctgatttgccttttgagattaatgactcagagactgccagttatttgttaacttgcttgattcagcctaagcagacatctagagggtgtaatttgatttattctgcagaggggtgattggcccctacattatcttggcacactgcctgaatttctgaacaccaaagacttatttatttagtgtatggccatctcatttccaagagtcaccaaagaagtgagaatggattagatagggaacaagctgaccattggattagtttatcagatgattagcatgccatgctaatttatcaagacatggaacatttaaagaaggggagagtaacatatacagggaagataggagatctttgtcccaattatttctttttttttaatgcatgaatagtcttttggtaaatatagtttatgtttgtttctgctttctaagttaggctgcaaaatattatttatcggtggtattctttgaaattgattggcatggcaagactgtaaaagagtatccataggtgtatttaaaaataaaagatcgtcttttcatctttgcagaaaaacatgtatttactattgcttggaatagaaagcagaattttgctgtagccattaggaagtgacaaacactacgccataattatagtgagaagaaagcatcaaaaagaaatgttttggttttttttatatacagttggcacaaaaatgtccacatatatgaatactctaaagaatgcaccataaaaagaaccttccaccactattaacaggattaatccgtgctcattaccatgggattggggatacatttttacatgttcttgattagattcaagagccaaagaataaggcctaattgatgaaagtgggctctaattttgtgcttttaaaataatggcctctggccaaatatgggcaaaagaaacagcacttgatttgttactttacatttgtttcttgcatcctgctcgaaaatagagatgatttacagttttaatatatttttcatgcacaattaacatcattgttgccagttttatagaagaggcaggaaagtgggccttctatgatttattgtgagtgcatgaaacagaagtaatgctactagcaacagagttttagtaggaaaaagttaaagcacacagtcttaaaaaggaaaggttggtgtcaaaattatgtttgctttaggtaagctttatacctccatggatggctttttttatagtaacaacaacagtaactgtatttacattggggccttttctctgtttcagaggctttcatgtggagtgccaaaatggtaaaatatataacattgttatatgaaggagtgagggaaaatccaatcaagattggcattttttaaaaaagaaaaggagcatggggaatattttaaagatttggggccaagcctcgtggctgatgcctgtaatcccagtgttttgagaggctgaggaaggagaatcacttgatccaggagtttgagaccagcctgggcaacatagcgagacctccacctctataaaaaagactaaaaagttagctgagtgtgatggcacgtacctgtagtctcagttactaggaaggctgaggtgggaggatagcttgagcccaggagggccaggcttcagtgagctgtaatcacatcactgcactccagcctgggcaacagagcaagacgctgtgtctcaaagaaaaaaaaaaaaaaaagatttggtatctttctttcccccacagtttgcatatacattgaaaactgtgcatttaagccaaaatagtttttttttttaaacatttcactataaaaaaggagtctggctttcacatgggtacatgattttgctttggcttcttcaattcccacctgccctgttgtgagacccatgaagtaagcaaagcattctttttgccacggaaatgaaactcctaaacatattgtttattgtcacataatggaaaggagaaacgtttcaaaaataaggatacatgaagcccttattgaaaagcaatcatacattggtgaatttaatgttttggagcaaaaactgttatgttggatacctattagtctttttagctagtgaaatatgtacaaggcaaaatcaagcatcaatagaagggtctaactaagcttgtttctcatatggtttctctgccagctcacacctcaagggtgcctcctgcctgcaatgtgtactctctggtccacacactgatttccccttttctgtttcatggggtgacttgctgaccttctctgtgcatggctagtagtactctattgactggcaagggttgtgtcttccacttgggtcttccaagctgctgaagaaagcaacacagaaagtatagctgacaataattatctgtcaaatgtatgtgaatcacagtgtggatggtcgacctgttgtttcttttttctctttgaaaggaagatttcagttttctctgcagccatggtactttataaattatttcctcttccatctcttaaaagtcactgttatttaccaccccattagctgtggatggggtgaaatgcccactcatgcagcacaggaggatacacagattgtcacacatcttttcaggagaccacacagcagtgggtagtgtagtattaaataaatgcctgaaatatgagctgggaatgcattgcacttcaaggaattttatccataggatgtaactgggaaagtgcagaagaatgcatatatatatagttgttcattgttacatgttttatgatagcaaaaaaaaattaaaaaatattcaactttcattttagacacggatttgcaggtttgctacatgggaatactgtgtgatgctgaagtttggggtatagatcccattacccaggtagcgaacatggtacccaacaggtagtttttcaacccacatccccctgtcttcctccccttctagtagtccctagtgtggagtgttcccatatttatgtccatgtgtactcagtgtttagcccccacttataagcgagaacatgtgatattttgttttgttttctattcctccattaagtaaccaaaatttttaacaatgtagaatccattacataattagagatacaatacaagcattgaataccagctgttaaaatggcattacaggataatatttagtgatatggaggaatattcagagtgtattatatacaaacattttcatcatatcgttttttactagagtggactgtcattttcttgtgggctcccttgtattatttactctattgcatctcagttttgttgcatattatgtaaaatagaagataatgatagcttggcgcattctctgctgagactatttacagtggtgtaaaaagatgttgccaggggtgtgtgcctcagtctgtcccagccttcgtagggccccatgtttcaactccctaatgacccattgaagacacacgggcacacaggggagaatgctctggtttaaacagtcaaccataagccagacacagtggtgcaacctgtgttgcaccttgtggtagcctcttgctacccaagaggctgagacagaggatctcttgaggtcaggagttcaagaccagcctgggcaacatagcaaaactcccattctaaaaaattaaagcaaactcaaccattttgagttttacatgttgtaaatatcttctcccactggcacccacccatcattcctggttttgattgaaacaaaaccattagttttaatgtagcaaaatgccatcaacatatttttctttctaacggtttctcctacgtagtgcctgttaaagaaatcctgttctaccccaacatcacaaaaacattttcctataagtatcagaatttcattgttcatacagacagtttttaatccatgcagagtttatttttatatatgaaatgaggtgggaatctcatgttatttttttccccaataggggaacattgctttgacacatgaaggaagcaatgtattcttttttttcttttgagacagagtcttgctctgtagcccaggctggagtgcaatggtgcagcctcagctcactgcaacctctccctctcaggttcaagcgattctcctccctcagcctcccaagtagctgggattacaggcacacgccaccacgcccagctaatttttgtaattttagtagagatggggtttcaccatgttggccaggctggcctcgaactgctgaccttgtgatccaccctcggcctcccaaagtactgggattacaggcatgaaccactgtgcccagctacaatgtattctttcccaatgatttgtggtgtcagccaggaccttgatagggataaatggcatgcaacttgagaaatgtaattaagatggggacaggatagtggagtccttatgtgaagttgctgatgcccgctgaggttgaactggacctacctaccagggagggaactggaggtcatatatacaggccttactcgccttctgccctccggattacctgctagtgtcttccttggctgaaacccaggagcagccagaaggcaagagtgaacctgtttatttaccttccacaccagagaggagtggagatgaggaaaagtcttgaaggggacagactcctccccccacaaaatagtacaagcttttaaaattcatcatatatacatcagccaatccaagggctttatatttggtcttgttgatttcctgatccattcctgcaagattaaagtatgactcaaatagtacaaatgcccatatatttttcatcttcaacattctcgttgctttttgtagaatttattctttcatatacaatatggaatcaatgtatcaaaatctgcaacattcttctgtctttgctgggaattgtatttattgaaatgttggtttgaggaaaaataaacatcttccaagctcatgttatctcatttgtaaactggcatagttcattacttgttgagatctaatcatagctttattaaagactttgagcattatgtgttaattgattattattattattttgcaaatgatatcttcaattacattttctactcctggtataaaagaatgtcgatcttttttatacattgattatatgttcagccatcttttttgattccctattatttctagtagcttttctgttaaattacatggtttccataaaaatggtgacattatgtacaaataatgaccattttctctctttcctttcaatacttgtaattttcatttcctttataacttgtaccattgtatggcccactgacgtccagtgcgaggatgaatactgttggtacaaacttttgttcccattcatgattttacaggaaatgagtctaacatcttttttgtaaatgcagcgttgaggagagattttaaagcatgcagtcattatcagataatatgaattacttgcaattcccagttttttctaagtttttaaaaaatgttttcttttgttcataaatgttgattatgaccaaataatcaactggcatttctacagctggttatatgattcttctcttataattaatgtgctctgaaaattaatatatttttaaatatatattcaatttcgggaataacacatttttaatcttaaaagaaacatttttaaaatggccattattctattatagtggaatatattgtatatgaaaaatagctactattctactaagtttggtttgtaaatattccacttaggttgtctacatctaccttcataaatgaatttgatttataattttctgatgttatacactctatacttttgatatgaatgttaaactgtccatacaaaaggatttgggtagctttctttaattgtatattttctgaagaaaacttaaataagtagaattactaaaatttttgtgaaaattatcttgggtggtgagtttttatgtgggagatttttagtgattctttcattactacttatagcttttagtttattcatttctttgcgtaaagttgctttgtttgtttttttcctcaaatatttcaatttctttttttaataccagggcttatactattaaaatagtattttgtattttttataactttgtttatttgttattttaaaaatgattttcctctttaaagactatttgttctcattatttgttgtatattatttgttgtatattgttgtatattatttgtttcattatttgttgtatatgttactcttccttggtcagtcttgccagaagtttgtttatattattaagcttttcgataaactagctttcattttggtaattagctcaactgttttttctctgtttcgctaatttctgctcttaccttgatcatttcctattttcagatttatttggatttattctgttttctcttcttcctgtttcttgacttgcctccatggctcgtttatttccaattcttcttgttaccttgtaaagatatttgaagttttaattatcccttttaagcacttcttcagtcccatctgacaaattttcacatgtgacatttgaactatcactggactctgactgttttgtgtttatacggtagcataaaggcacatgcacacatatacatacacacatagatgtgtgtgtgtatatgtttagtgttctatcattattttgaatgctttttactattgatttctaattctgttgaccgatagaatatagtgctgaatgctgctgtttctttaaagtactctttatgaaaggcagattttgtaaacgttcggtgtgtgcttgaaagctatggacacatttacacatacatagacatattcacaaatacaaatacagatatacgtgtatatgtgagaatgtgtgttttgaggagcataggtttccatagatacccaccagatcacatgtatgggttacttcagtcttctatatcttatttgttttggtgggtggggctagggacagagtctcgctctgttgctcaggctggagtgcagtggcctgatctcggctcactgcaacctcggcattctggcttcaagtggttctcctgcctcagccttccaagtagctgggatcacaggtgcacaccaccacgcccagctaacttttgtatttttagtagagacgcggtttcactttgttggccaggctggtctccaactcctggcctcaagtgatccaccagcctcggcctcccaaagtgctgggattacaggcgtgggccactgcaactggcctatatcctcaattacattttatttcctaagtttatcactccaagaatgttgtgttttattctactgtaacattttatcttttcttatctgtcctttatcttatatatttaatgtatatggatatactatgttatatatatgtagtatgtatatataaaatgtacttatataccttttacatgttttgaagctgtattattaggatgttacatgaaagtgtcagttacacctttttaatcttccattccttttctagtatttattatccatttttgacatttacaatttttgtttgatactaaatttgcttcctgtgatattttttcatttatattttgttttatatttaaaatttttagtgtcttcattttcaagtttatgtatccatttattttaaatatatcttttcaacaatatgttgctaaaagtattttaatcaatattttatctttattctaattttatttctgcagttatcattattatagatttcacttctgacattttattttatattttatatttatcaatcatgctttttaaattttacctttttttttttttgctttacctgacttccattatataattttaaaagtttcttttactgaccttattattatatttttctttcttctgtttttttttccttatagttgggattcatcaaatttccctcttcccattttatgctgcacttatattttaatgaagatgtatctagtcttattagctatcaaacatttcagtatccataattttcctcaaaacaagatattgatttagcattttctctactcttcggcatctctctctctcaatcaccccacactgtgttagattctaagagaatctgggctctagatcatgttaaaaatttgattttagatcattgtttcttcggaataattttttgtcgttacctgtattatgttgctgtgttctgggttcctctccttgcagaaatatattgtgtcaagatttctgtgatgtaagtggatttggatttaagctatcatttaaatgacagtttcactggacataaaatccaggctgattttctttcccttgtacttgctgggggtgagaagccactgcattttgtatcctacgttgctttgcaattagcctggttttcattcctttgcacatcgcctgctttttctccttggaaaaattagacatattttgtttacatttgaggtactcaaaaattggaatttgtttttgctttgttctgttttaaatcaacgtattatttactttgtgagtactttcacttttaagcctttttttttctttcattctgggaaattctcagcctttctgtctaatgtagttcttcctagtctttttctctttgttctctttctgggtcatttttttttataggactggtaacacttctatttccatcttccatactttagcatttggaggatgtttttccaccatttttcatcccagatccattttgggaaaatgtatctctgtcttttggctcctatgtgcattgtttgtgggtatccttccatttcagtctgttctttgtgctctccagttcaacaatttcatttcttctccccggtatctcgtgtgacttcctttgaaaccctttgttccaactttatatcgctatcattgtctctctgtccattggagggatctgcttcttttgaatcccagtttgtttacttgggtcattttattattattattttttaaataggatgttccttttcttttaagtgctttgctttttgactggctcttaaaaatttcttgggagttcttttattttcttgaggccggtagaggtcttggaaggtaccaagtgtccaatgggcaatcaaaagcccacctctctgcctggcgcggtggctcacacctgtaatcccagcactttgggaggccgaggcaggtggatcatctgaagagttcaagaccagcctgaccaatatggtgaaaccccatctctactaaaaatacaaaaattacctgggcatggaggcatgtgcctgtagtcccagctacttgggaagctgaggcaggagaatcacttgaacccgggaggcagaggttgcagtgagcagagattgtgccactgcactccagcctaggtgacagagtgtgactgcatctcaagaaaaaaataaaaaacaaaaaataaaggcccacctctcgatttcatgcctctgggtaaattggagggaaaagagggtccctctgtgaagagcccttggaactcgagttctaatttctaaaccaagaactttatattctttcctccctccctatcacttccatccactggctggctcttatctgaaaactgtcgtgtgcagttataaatactcaacacttagggaaggagaaggaattctgagagatttcgccagcctgattcttttcattgccataaaattccactgctttaccagaaatccttggaatgtggctttcctagctttgcactgtgaccttcttcattcggaataacgaagatgagaaaagcattgatccgcccagacagtgaggagcgaagagcaatacctaggtggaaagctctatctcccctgactgtcctgtgaaatgcacctgagtctcagaggactccactgccatctgtctgtccaggaatttcccattttgtatggcgacttcaaagtaggtaaatactttgattaaaggaatagagaacagaatttgggtagcttgttcaaaagatggcatggaaaattctgtgactggagtagttgtgaagcatcactcttcccgtaagaataaaggaggcatttgccagatgtctgaaaacacacagacacacacacaaaggaattacttctggctgcaagaatattctctctcagcatcttcctgcatctccatgggcaaacagacccacaacagcctgggattttttaattgccaacagttttcattgcatgagagcctgacatgtctgttgcatgatagggtgtgtttttatttttggcttcctattggtttcaacatatccctccttccatgtcataatgacaattacaaagacctgagttgaacctagaacgctttttttttgtcagacacaacaatgcagtggatgttagtcatagggtaattcaaacagagataattttgtatattctagaatattatgttttcaaacgtaggttttgatgtaccataagatttcttctgccattgaggcgatatatatgtgtgtgtgtgtgtgtgtgtgtgtgtgtgtatgtatatatatgtgtgtattttaaatttaaattagatattttttagaggccttagcccttaagcagaattccctcctaatttaatgattttggacgaagctcattgtgaatcatttaaaaacacattcatgcttcttcaaacagaggtaacaaaggatacagcaccttgacttgttgactaagtgctgtcatggtagatgttatttagcatagaagatgcctgcagggtcagttctactctctaaagtttcttgaggctgtgttaaatgaaatcaaacacctgtggattttttattcttgttcacgctttttatacctctcctttcttctccctgggcaacctgctttcacactagtgcctacctctgttttcccttcagaatgtgatctatgctacacaatctgattaacaagctcaacagagttctactggacatagaataaagaaaccagtatagttttctctctagggacaaggcagtgaggaagccagtttgaatacaggttcttgctcttgtaagcattgacattcagcaggttccttactttctgaacactgcagttatatgatgggcagacagggactaagaataacacctacctcaacggggctgttgtgaggattactgagataatttatgtaaatccctagcacaatgcctgactcatgcgagatctttaattcatggtagcagttactaatttcatttatcataatgagctgcctgagctaccaaggagctctgccactcccagtactgttctacagttctttaattcaacaaagaaatttttctttagttccaaataagtgccaggcatcaggctaggtgctgggtgtatgatgatgatcaaaacagtgttcgtatgggggtagtcatcattttgtcgatgggccattttttatgatgtccctcttcattataggtcttgattcttgcctctgttttgtatacatatgtgttgcggcaggggcttgctataaaaatcagaattgcccaggctgagcgcagtggtgcaatcatggctcattgcagcttcgggcttcagtgatcctcccacctcagccttcttagtagctgggattacaggcacactccaccacacctgcctctgttttgtgtagctgtgattacgtagcaattttctgaatcagtgacaagatgcaatgcatatttttttcagtaggttaattaatttatctaatctacatttggagctattttttggagtgttagtcatcataataaatatggtggcactgtcaatagtaatataaatataatggtaccttaattccataatacaaagatcacgtcttcatgactgatgggccatttcaaacccataggtacatttgctcgctctgtaaagtatacaaaagtaagaattctggacatctttaaaagttgtaaatttttacatgaaaacttacattcacaccatcttttgaatattgaaaagatttgggaacatggggcctatatgtgactgtggatgaggtgtggctgttccctttagacacagcactcactttgccatagtcacactccccaccgctccctattgtgtctccaacccccaggctgttgtctgtttcttttccaacgttattacccactcatagatggtcaaccttatgatcattgttactttcttttcctcagaatctttctagtatttgtgatttttttcatgtggttattttgagctttttgcattaagaatttgggatcacatactcaaaagtttagtatttaccagtttgtattattgagcacttcagaaatttatttctgttgctgttatcaactcataaaatatctgtttaattatccaactaaagactagataggatagtgattcctattttctccaagctcatatctgtgaactccttgattgcccaacataggcattcaatcattcattcaacaaatacccattgaggacctactatgatctgggcacttttctaggtgctgataattgtagtgaaatagtagaccacagtggacagtgtttctttatggaatttaagtgaataaggaagttattttggagtatttcagatcgtgattcctgctacgaagaaaaataattcagaataaagtagataaggaataataggaatggacccacacagttattatttttattgctgtggtcatactgatatctgaagcaagtaagagaagagtttcctatgaggatggaatagcatgtgcaaagaccctggagttgtagaatccttgatgcgtccaaggaatatggagaagaccagttgggctagagttgacaaaatgagggtgaagtgggggtataagaatagagaggtgctggacagtaggccgttgagagggctttagcttttccgtgatgaatattggaacccacaatgtaattttgagcatgaaaatgagagccttgatttacatttttatcagatcaccctgagttctggttggagaatgagctctaaggatctgtgggtatatttagggagatacttaggtggcctttgcaataatacgctcaagggaggatgctggcttcaccagagagctgatagataagccatggccagattctgggaatattttaaaggaagatccaacaaatcgattattcctagaatgcagaatgaatgagaaagagacaacttatggccaaccccaattcctttggccgccgtaactggaagaattgcgttgccatgtgctgacaacagggagattgtgagaggagcactttagggtgagggaattaggagactgcttttgtttaagttaagaacaaccaaggagagatagatgtcttagagacagctgggtacagtagtgtggacatgaagagagaggtctacgctggagatacaaggtcaggagacatgagcatgtagatgatatttacagttgtgagactgaatcgcatttccaacacaatgaatgtagatagagaggagaagtaagtgtactagaagaaaaagaaggatgaagaggaggagagagagaagacagtgaggaagaggaaagaagcagcgtgcatgtgtgcacttgtatgagaaagagagagagagagggagaaagtggaagatatagatagaaggagagagagagagactgggggaagaattacatccacccaaaacccaaattttaatgacttacaatatgaaagcttcattttttttttctcttatgttgcacctcactgatggactatcatcagccccacttctcttccaagtctttattccagaatccaggctggaggccatgcctgaactgaggaaatggtgttcatgtacaacagttctttcagcttctgctcagatgtggcattgcacatccactcatatgcgattgtccaaagcatttttctattctctgggagatacttcaaggggcacaacagtggctggggattgagggggctgtgaatagactttcaggaaaaaggatcagctgtgctaaatgctgctgatgagtgcagtaacacaaggatgagtaacttgagtagcttgtagagaggtataggccatttgtttcatgcccaggaacaaggcaggaccaggaatcctggttgagatgctgcagtttgggctagttggaggtgggggcaagtttttctctcactgctgggacttactcaggttaacagatgggacgttgtggaggagctggagacggaggagaaagtgtagaagagttaactaggagatggattgagagtgtttgatgtgagaggcagtagagcatgcattgaacctaggctgtatggttggagggtttttttccagccatgtcctgtctgctcaggttcagaggaggtaggaggtagattgaaccagccacaggtgatgctccatgagtaaagaagggttgagagtcaggaattgaggagtccaaggcattaactgaaaagatggttcatggaatttaacaaagatgcggacaaatatgaggagaggaggcagtcaagggagagagaaagagtagggttgggatacagggaatgaaagtgagctccttaagatgaatggctaatcccacaaaactggccaattcccataaggtgaacggctaatcccattagtgcattgttgacatgaaaatgtcctcaccaaataatgaagaaaaatttgattttcttatgtggaaaaagcaggaccaaaagcaatcaaccaaaatcgtatctactacctggcagtccattagaacacactaaacacacacataaagagaaaaatgaagtatgttaattgtgaaacttgtatctccaaaaactggaaagcttcttggcacttaaaagcacttcttggcacttgggattacttgcctgtaatcccagcactttgggaggctgagacgggcggatcacttgaggtcaggagttccagaccagcctggccaacatggtgaaaccctgtctctagtgaaaatataaaaattagccgggcatggtggcgcatgcctatagttccagctactcgggaggctgaggcagaagaatcacttgaacctgggaggcgggggctgaggtagaagaatcacttgaacctgggaggcgggggctgaggccgaagaatcacttgaacctgggaggcgggggctgaggcagaagaatcacttgaacctgggaggcgggggctgcagtgaactgaaatcgtgccattgcactccagcctgggcgacagagtgagacgctgtctcaaaaaaaaaaaaaaaaaaaaaaaaaaaaaaaaaaaaaaaaaagaaagaaaggttcaatacctacttgttgaatgaaagtggacgtgtgaattcaaagtttccgctctttcacagtgtttttttttttttttttttttttttttgacagagtctcggtctgtcgcccaggctggagtgcagtggcacaatcttggctcactgcaaactctgcctcccgggttcacgccattctcctgccttagcctcccgagtagctgggactgcaggcgcccaccaccacgcctggctaattttttgtattttgagtagagacggggtttcaccgtgttagccaggatggtctccatctcctgacctcctgatgcacccaccttggcctcccaaagtgctgggattacagacatgagccaccgcgcccagcctcattcagttctttattacatttgtaaaggtaactctaactccgtgagagcactttctcgctcacctcttaattcttgagcaaacagagaagctgtgcatgataaagctggagaattgggtggtgtcttcctattaagcttacaggaaagcactgggcatttggaacagatgttgcatcttgagagccacagagtcaggtgtgcacgttaaaacgatgcttctaattgttgcatagagacagaagacaatcacaaagattctgccttgacctccttacctctccagttctaaaaacatttctcccactacagaaagcatccatctatgtgttttttgcctccacgtggtcctattcctgaaatgctccttccaagtctgtacttttccaagagctactatttctggatcttttgcagttgcttcagcaagaatcagttctggcttccttggttctaccatgccaactttaccttctcgtccctcagtgggatgctagggcttgggttaattcatctctctccttcaaggcgacatgaagcccctgagaacaggggcatatttttgcccagccattacctacaatgatacaggagtcctgtaatattcgttagagaaatgtgtccactgaacatgaatttcctatcctgttccttctaaaaaggatgcatgagttatcctatattcccaaggcacaacatgactttgttctgatatgtgccaccgtgatcctgtagaatttgttttgtttccagtccctaagaataaatgtctcttaaagtattgtagtcattcactctacatttttatgagttattactggcccacctacaaccatatttcctccgaaattcatccatcctcctggaattacctgattctgaattattaagtggttctcttggccatttgctcaaaaaaagagcacacttattccaacacacaggcattgtttctaaattattattgttttttcttcctagaaaccatttagagatgaagatccactttagaacatgaacccatttagtttagactataacaattgaagatatggtgactactgtttatttctgttagggatatattttttgtagatttcacaaaagacagaacctgctgtgtgacagcttatctgcaggacaccgatggtttgtaggacgatggtgaggctttgtgacaaggcagaaatgtggaaggctggcaagattgtttactgagcttcccctaaggatggaataattcaccaatcccacaactcctccaccctcagtcactaccaatagctgtgcctcagtgttttctttttaatgattgtatgtattaagaaaaaaatcctcatatgtagtgtttagtttatctgattttcgttactaaaataataaaggagaaaagtaaataattcatataaaagtaaactttcttattccaagcaggtgtatgtgtgcatgtttgtgtgtgtgtgtgtgtgtgtgtgtgtgtgtgtgtgtgtttgccactttgatggaaagaggctgactttgcagagactattttttgttaagaactttccattaaattagagctttaagttataacactgattgcataggccagggaaaatggtaggatgtggcttaaaaggcaatctcacaagaagtatgacttttatcttatattataaacaacagcacaaccttggaatttgtcccaataaattccataagtataaaataaactaaataagtaaagtgactaatatcctactaagtcttttccttcacacatgcttttttgcctaaagccatttaaagtctctgaggatttaaatctatgattctttcatggagtagaagaaacccagagaatatagaaatttagaaaaactttaagacttattggtttaacagaagtaggccgggtgcggtggctcatgcctctaatcccagcactttgggatgctgagctgggtggatcacttgaggtaggagttcaataccagcttggccaacatggtgaaaccccctctctactaaaaatacaaaaattagccgggcgtagtggtgcacacctgtagttacagctacttgggaagctgaggcaagagaatcacttgaacccaggagacagaggctgcagtgagctgagattgcgccactgcacttccagcctgggtgacagggcaagactccatctcaaaaacaacagcaacaaacaaaacaaaacaaaaaacccagaggtagatctaattctgcagactgcaatcactcagttatggatggataagtcagtccttaagtccatctgctatttgtgtatcgtgcatttttttttttttttgaaacaagcacgttcccacctggattgaatgttaatattcactgaaagccagggcattgcaacgagcccttaggatgttataattctgggccatttttacagttcaggatttcagatttattgcaatgttgtaagtttttagtttcttgtctttctctaacatctagtaagttccaaaacttaaagaactacaggttttcttgataaatacctgtgtcactactttttatttttagatttttcttttttactacatgatctgagttaaaagttaaatatatatgaattattgttttgaaaaatattacctataatagttttttaaaagaaactttaattttagatttgtgctaaattggcgaagattgtgtagagttttccttataccccaccctcaaattccactactagaaacaccttacatcattattgtacatttgacactattaatgagccaatatgtgtgcaattttttactaaagcccacccattcttctgatttcgttggtattttccttctgtcttttttctttcctcaaatcctatccaggatcccacattacatttagccgtcatgtctccttgagctcctcttgactgtgacagtttttcttcttttgtctttcatgaccttaacagttttgaggagggctggtcacgggattggtaccttgtttggtttgtctgatgtttttctcatggttatactggggggctatggattgtgcagaggaagaccagaggtgaagtgccactttcattacattgtatcaagggcacatactagcaccatgacattgcagttgatactaaccttgatcccatggatgaggtgatgttggccagatatctccagtatcacgttcgtcctcctgcacacacactttctatactgtaccctgtggaaagaggtcactacgtgcagcctacacttaagaaagcaggaggccgggtgtggtggctcacacctgtaatcccagctactccagaggctgaggcaggagaatcacttgaacccgggagaaggaaattgcagtgagccgagatcgcgccattgcactccagcctgggtgatagagcgagactccatctcaaaaaaacaaaaataaattaaaaaaaaaaaaaaaagaaagcggggactataatcccctccttgagggcagagtatctacagaaattatttgaagttattttgcatgagagatgtgcctattctcgcctactcatttatttattccctcatttacatatatcagtatggactcatggatatttattttatactttgggttgtaatctaatgtgatgttgtttatctgcatagattttgtgtttacgtaactttttttcaaattcctgagggatagctttttagaaaatccctgtttttactttagatccaaggattacgtctgcaggtgtgttacaagggtatcttgtgtgttgctgaggttcaggcttccgttgatcccgtcactaggttattctgtgcccagataatgagcacaggaagttttttagtccttgtcccccctctgcaacagattgtaggaaataatctgagactgatcatttttaattttcaagcactgaacatgcagttattttatctagaaggtagaccagcaaaacaaaattatatttgacattttagcatataagtattttctagttaactttgacatacaagaagccaggttatgaatgtatttgttcatgactctagcttgtttggttaaaattattctcctgccaaccaaatgcttttttgctaccctgaatatttaaaaaatttttacaatatttcatctttaagagctataaatgtatgttttaatatcccagggtaagatatagggatattttttagtctgtcgaggctgctataacaaaataccttagactgggtaatttataaacaatagacatttattgttattattatcattaagacagggtctctttctgttgctcaggctggagtgcagtggcttgatcatggttcactgtagccttgacttcctgggctcaactgatcctcccacctcagcctcctgagtagctgggaccatacgtgtgtgccaccatccctggctaatttttatttttttaatttttagtagcgatgaggactcactacgttgaccagggtggttttgaactcctggccttaaacatttctcctgccttgacctcctaaagtgttgggattacaggtatgagccactttgcccagctaacaacacacatttatttctcatggtcctgggaagtccaggatcaaggtgctagcagattcagtgtctagtgagggcccattcccccaaatggcatcttcttgatttatcctcacatgttggaagggacaaggtggaagggcctgcagcctcttttataaggacactcatcccattcatgagggtagagttatcatgttgtgtattggatttcagcatatgaattttgggaggacactaccattcagactatataacaagatacattaggtttggggtgttctgcacttgagtgaatctatgtaagccctttcacatatttttactttcactgaaataaaactaaataaggaaaccaatgctatcctatatcttaaaatgagaatggtttgtaacagctcattgccttgcatcatggtcttttagggttagggttcgggttagggttaggattagcttcgctttgctgggcagagtaggtatttccgcctcgaaccacctctaagggcttcagctttcagtaacgcacctgtcacttctaatgcaaaaccttgagtcctctgtctgtgtgcagattcaggaacaggtttgaggtctaagaattttcttattattgccttccatttcaatttctagttcctccaaagtccttcacaatgatgaccgagaggagacactcaaaaatttgttagccagagtctcaaagtacatagaagctgtttctcttgggtggatattacaagtgcctctacaggcaactgcatttctttctctttccaggatttttgcttattgtccagatatgctcctcctagtgagagggacacttctgatttttcctgcctccatggaacaggggcttcagagaagaaactctctacagccccttcgttccattaataatttataattaaatgcatttccagcatgaaggctgcctaggagtagagaagcatattagaagaaccaatctgctgcgtatctgcttatagggtttgagcccagtcaaggagggatgcacagaaactcaggattctgacagcccagcccccttgcaattgggagggtcgccaaatttctttcttgcaaggggtacttactgtctgtgagtgggagcctcttgtggataaggagtgagggcagagagggaacagcagagccctgggaagttctttccacttgactctgagcgtctagacagcagcctgcccccaccccctagattggctttgtacctgtgagcaaagtttctgactgtgccatacatctctggaatacatttagttgctaatggagatattactataattccacatatgtttttagtctctccttggggctgtgcccttctgtgtggcttggcagaagagaaaggagagaaagattatacatggcagccttgctttggagggagtgaaacctgtgattttccttttctgtgtcaggaaagcgtttttctgctgcttgactagccacctcccaggcacattaaccagtcaggtgatgctgacatttgtaccccctaatctggcttatttctgaaaccctccctttgagccctaactgctataattaggagactggatcctaacaggtttggaaaaaggtttgcaatctcaaaataaagtagtgattttgaaagagaaatgtatagtagagttagctatggggtttgcacattctacatttatgtttgtttgtttttattttttcgctcagactgctcacagatgcagtgagcacacccaaatgcatgtgatcaatgcatgtctgacttctgcagctatggaaggtctgggtttgtaagatcactgctgtagacccttgtttgacctttttggattgctggatcagaaagtgagagattgcgaaagttttcttaaaagaacaagtcagtgaatcaattcattaattcttttgttcattaggattagttaatatactgctacagtaaaaccttttgttattgtctgtaataataaaagttggattatggcatggctaaccccaatctccatacaatctgctcatagttttgacctcattctaatataaccctgtatttcacgtgattgaatgttttgcaccatatttataatattacatccaggtattacttggtttctgaaggtttataaaattgtaaatgcagtacatagggtattagagattttgttgttttatttttttagagactgggtcttgctctatcaacccaggctggagtgcagtggtgcaatcatagctcactgtaaccttgaactcctgggctcaaacgaccctccaccctcagcctctggagtagcttgtattataggtgcatgccaccatatccggctaattttttattttgatttttgtagcgatagcatctcagtgtattgcccagattggtctcaaaatcctagcctcaagcaatcttcctgcattggccttccaaagtgctgggattacaggtgccagccactgtgcttggccattacctagagtttttgttagagataatgaaataagaatgagattaaaatgaggttagtctcatgctgcttaaaacagtgatatgcttaggagcagctgcaggaacatctgatccaatcttggaggcagcctggagggcttcccaggggaagcacaatgtagtccaaaacctgagagatgagcagggattgactaactaaagagcagacctacacaccaaattctgccatcagttccttgcatggcatggaaaattgatttctacaactacgcagtatttttcttcctttttttttgaaacagattctcgctttgtcacccaggctggagtgcagtagagcgattttggctcactgcagcctcgacctcctgggctcaagtgatcctcccacctgagcttccctagtagagtagctggtactacatatgcacaccaccatgcccagccaattttttatttatttatttatttatttttgtagaaacagggttttgccatgttggccaggctgctcttgaactcctgagctcaagtgatcagcccacctcggcctcctaaagtgctgggattacaggcatgagccaccatttttatttggtatgtgtgcattcatagttattctacaaaaaataatatttaataataattcacagtatcctgcagattccaaaataaagtaagcttaagttctgttggaaaatgaatttctgtgagaaggctttggtgctttgacttgaagctgacatcaacattagtgttgggcatttggctacacacctgtcacattcaaaagccaattcactttgagtctttattttgttggcagtaagggctgcacatttcgatccactgtgtattttcctagcccagattccactcaaagcagaggtttagagaaaacccttgtttattgcaaatattatgccaaaaatagggatgaggaaccagcactgtgttgtgggaaggaacgagaaataatcactatttacaatagccgagttgtggaatcaacctaagtgtccatcaacagtgcattggataaagaaaatgtagtacatctacaacacagaatactaggcagccataaaatagaatggaatcatgtcctttgcagcaacatgaatgtggctggaggccattatcctaggtgaaataactcaaaaacataaaatcaaatatagcatgttgtcacttataactgggagctaaacaatgggtacacatggatataaagatggaaacaatcaacactggggactcaaacaagggaaaggctgggagggggtgagggttgaaaaattaacctatgggtacaatgttcactctttgtgtgattggaaccctagaagtccatatgtcaccagtgtgcaatatacccatgtaagaaacctgcacatgcacccctgaatccaaattaaaatttaaaaacaaacaaaaacacaaaaaagtgtattggccacagaggagtgactgctgcttgacccagtgaggttgtctgaaaacccttatgttatgtgtctccagaccacctttacccggtgaaaatggaggacccatattcacaccatctttcacctcttattagtttactgggggtaacctctccaggctgcttggggagtgctaagtaggttttagtgtgcatccactgtgaggcatcagagaaacttcaggaaatcaagaaaaaggcaagtttgcaggtatgaagtgaggctgcacctgcgtgaagctggctgaagtctaggcagagcagatcaccacaagagcggctggaataagccatgtggccgaatggcatccagcacaacgatcaagtgaaacagagctcctccagctgtggtagaactagggccaaagtatgtgaaagtgttcaaagattcttcgcattgaattcaagctcatcattgtccacaaatcaatgagaccatgtctatattggtaaagaaagaataaagcataaattcatatttcaatttttaggttatctgaataaatgaatttcaagagtgcttaaggtttttgctagatgtttgcaggtttttgcctggagaggcacaggcagttctttgtcctatcattctagccttccacttgtagggattccctggaaagttgacataaccgctgattcctagttctgttttgtgggaagtatcaagattaagagaccctctgggtgaacaagatgtctttcaatagatgaatgggtaaataaactatggtgtattcagacaatggaatattattccatgctataaagaaatgagctattaagccatgaaaagacatggaggaaaattaaatgcatattactaagtgaaagaagctgatgggaaaaggctacatacagtatgattccaactataggacattctggaaaaagcagaactgggggacaataaaaaatccatcattgtcagagtttcggttggggatggggaaagaaaagataaataggtggatcatagaggatttttatggcagggaagatattctgtgttatactgtaatggtggatgcaaggaggttctttttgtctaattaactgttcacattcatcataattgattccatacagtatgcatggattttcagggtccaagtgttaaccaacttcagtggacttaaaccactctgtaaatggggtgctctttagtgtttgttttgtttactgttctaggactggttaatagaaatcagaggacatacagatccagagtcccttatctacaatttgaaagtcaaaaacagttcaaaactttacagtgatatcaaaactcatttgggggcaaaacctgatctgacagatgactatttgtgttctttcttttccacctcagggtggacatttagatattttcctgcaggaatattaatgagtttgatttgggagtgatgttccatattcctctgagggtgctgcataaaacagatgtaaaaaaattaaaaagttctgagtccccttcctcttgtccacaaaagcatactcattcccaagggtttcagatccccattggtggatctgtgatatcaaaggtctcattgataatgttggtggtcagtggaaaatagttgtgtggagagagatgtgttagtctggacctcatgcaatgactgcagaaataattttatgatttccaaagaacaacagacaatctaaccacctcccttacctttaaagactgacatctgtgttgtgttcatggatgattatgcaaatcaagaaaagtggcttccatcaaaataatgtcatttctttttggagaaaagagcctgggactgagttgtgttatgtgtgcagtttgccagctaaactcctggcttaatgattgggatgggtttccaagggctggttctgagactcagtggcagttagttaggtggtaatttccccattaacattaatgagaaatgaaataagttacttaagaaaacgtgctagacgatagtctctaagtactgaaaagtaaatgaacccacctacgtttgttcacataaaatttcttagtatattttaaatttgctaatctaatgtacttttttttttgcttgtgctttaactttgttaaattatgtcacgtaaaacattttattccatattctaaattacataaatgtgtcacacacaatgtcatgaatcaagtttgtctaaagaggagataggccaaggcaggtggatcacttgaggtcgggagttcaagaccagcctggccaacatggtgaaaccccatctctactaaaaatacaaaagttagtggggcatggtggtgcacacctataatcccagctactcaggaggctgaggcaggagaatggcttgaccctgaaaggtggaagttgcagtgagtcaaaatcatgccactgcattccagcctgggagacggagtgggactccatctcaaaaaaaaaaaaggagataatacactttcacgtttgtaaaataatgttgattaaatggtctaatgtgattttatcttgctaatccagttaccgtcccagtatctgaattatgataacagtttacgcagcatagttttctaacagttttggttccatctctgctattaaattcaggccactggatctgtttggttcaacttggattagggtgtgaggttctgttttcctacctctaactccatatacattgtccgtgctcctgaccttccatgcaggaggcttgcaggtatctccttaatctgtctgtcatctgtttctttctgccatctcagggactcctgatctttccagactgcccatcctctcctgtccctttgactcttccttttttgttcactttctgtaactccagtctgatcatctaaatagtctgaggggaagatgaggtactgaaggcactcttgtgagaatatttctcaggttcctaggtccaagtttccgttgcatcttggtttctatttcagtctgagcagagagagagagagagagagcaaaaaagatcttcaggataaaagtgagagagagagaagatggagaaataaatataaatgaacaactgataaatgccttgagctataactctgccaaatgaacacagaaactcatgtgcagttagatattatccacctgagaatgtagttgataacatatttcatcataaataatatcgtctaaagcccttacttgggaagattatgaagcaagccaaatcttatgcagtatgtccttctgttctcttgacaagcataagtttctatttctgtattgctagaaatttttagtcacatgcaattccaacagtgctttaagctggttattactaagtagaaggtaaatgtttgatgatggaagaatttgcggtggaggtgaaatttaggataaatattagcaactttgaaaagtaaggtgtagatctgtgcggtaccagaaaacatttaacagattcagaagttagtttatgtgtacctatatgtgcacacacatacacacacaatgcatgcacacttatgcaaatcacacacacatgcctcacgcacaagtgcaacactcaggtgcacccaattgcacatacgtattctattactattctttgcaatgctttgaatgctcatcatgtaccacaaagttatggtctaattcataataccataaggtgcgtgtgctttagagatactgtgtatttcctttcaacatcgaactagtgactattaatgttttaaaatcaaatttgataacattctgaaataaaatactgatgtattaagtaccaatgcgttgacatcaggtttcataggtgttgaactgtagcgaggaaaacagttatcaggtgtcctactgtaactctacccagcaggaaagctctatgtaatgatggtagaatatccaaatgatggtgtccacatctgcacaggtacgatttgagattcactgacttatttaggaggattcagtaaaatttcgcagatgttgttatgtagtaatatttggctcattcatattctgcactcctagacattgcagaaagacatgcaactgtgatttccatctcatccctttcaccctattttgaaacatttagttatgtctactagttaccctaagttgtattttttaccctctaaaaaggaacaagagaagttggaatccatcccagctttccttccagaaaatggaggggaggaacaattggaatggagaggaactccagggagaaaaagacaaaaggcacatgagtgagtttgtctaggctgggagagtgggcgatcacatgagatttgtgaactaattttgttctccttctgtttccactgataagcactttatgagtgccaccagtgtaagtaaatattaaacctcatctcaattagtatctactcttttccaaatatatgcttatgtcagaaaatgagcagtagaaagcaaccacaggataccacctgcacacccacgggctgagcattgcatactttcaaggagtgctgttgtgttttcaaacttagtaatttcccaaaacagagaattcacagcttccctaatcaccttcctcagaaccctgaatcttgttaattgagtcatttttctgatgatcatgtactcatacaattgactaaatgtctcactatgccttcctgataagtagtgtctctacatgtgaagtatctatttaatctatctacccctctctctctatctaatctgttgatttcttatctatctaatttatatctatcatctctatgtatctatgtatgtatgtatgcatatatgtatgtatctatatatatatcgatctatcttatctatatgtatctatcatctctatgcatctatgtatctatctgtctatgtatgtatgtatgtatgtatgtatgtatatatctatcaatcctctctctctctcttagttcagcaaattacttacaggtttttgttatgtaactgagcaaaattatatacacacacataagaaggctggaagttcaagatcaaagtgcttacagattcagtgtctggtggggacccacttcctgattcatagacagcgccttctcactgtgtcctcacatagtggaaagggcaagggagctctgtgggatcccttttataagggcactgatcccattcatgaaactccactgtcatgacctcattacctccaaaaggcgcccacctcctaatactgtcccgttggggattaagatttatatattttttctttttaatttctaatttttgtgggtacatggtaggtatatatatttatggagtacatgagatattttggtgtagacatgcaatgcataataatcatatcatagaaaatggggtgtccatctcctcaagcatttatcttttgtgttacaaacaatcaaattatattattttagttattttaaaatgtacaattaggccaggcacggtggctcacgcctgtaatcccatcactttgggaggctgaggcaggcggatcacgaggtcgggagattgagaccagcctggctaacacagtgaaatcccatctctactaaaaatacaaaaaaattagctaggtgtggtggcgggcacctgtagtcccagctactcaggaggctgaggcaggagaatggcgtgaacctgggaagcagaggttgcagtgagccgagatcatgccactgcactccagcctgggcgacagagcgagactcagtctcaaaaaaaaaaaaagtacaattaaattactattgactatagtattgactatagtcaccctgttgtgctagcaaatactaggtcttatttattctttctgactataatttttgtacccattaaccaccccacttccccacatcccacccccactaccctttccagtgcctgataacccttttttgactctctatgcacatgagttcaatctttttgatttttagctcccacaaataagtgagaacatatgataacagtctttctgtccctggcttatttcacttaacataatgatctccagttttatctatgttgtaaatgacaggatctgattcttttttatagctgaacaatactccattgtgtatatgtaccacattttcctttatccattcacctgttgatggacagttagtttgcttccaaatcttggctattgtgaacaaagctgcaacaaacatgggggtgtggatatctctttgatatactgatttcctttctttgggggtttggatataaacatatgaattttgagaggacagaactttcagactatagcatactgtaccatctatctatctgtccatccatctgtttatctgtctcccattcctgaatattgcatggcatattttgttaattatttccaatgtcatattgagttttaaagtaagattacatttctgagaggcctcacgtgggggcatcctgaaaagtacattctctttatagtttaaatgttttggtttttttctttatttttttcatatttaattatatttctttcaagtgactcctttgggagacatgattttcctacctcctgggactgccacaattcccctgcctcttggaatgcaatcgatctctagtctgcctcaagtataaagatgatattcatgttgatgacattgagaaggatgaggagaaaggagttgatcagagatctatattcatggtatatatgtttatcgtatatatatttatctgcttatcgtcttcagaatataaactccaagactgtgggtctttgttttcttcagtactaccttgcagagtctaggcctatttattcaaagcttaatatttgtgaagtgcatgaatgaataaatgaattctaatgttatcactgccgttggtatggtatctgtttctctatctgtattgtcctctctacttttcattatttgtttaattcccactcattgagacagattgcagaagattcctttgccaactacttctgggtagagataaatttccctccacggagctcccactggactctacctgcagctatatgttatcttgtattttccaacactcagctgtaccacataagacttgattgagtgaagaccctgacttagctttgcataaaaccaaagtaaatgctttccacacatagccattcacagacattttcacattttatacagcaactgatgaactaggctagtgttgggaacaggccccctaaaatctggccataaacttgcccccaaactggccaaaacaaaatctctgcagcactgtgacatgttcatgatggccatgacccccatgctggaaggctgtgggtttaccagaatgagggcaaggaacacctggcccacccagggcggaaaaccgcttaaaggtgttcttaaaccacaaacaatagcatgagcgatctgtgccttaaggacatgctcctgctgcagataactagccagagcccatccctttatttcagcccatccctttgtttcccataaagaatacttttagttatctataatctataaaaacaatgcttatcactggcttgctgttaacaaatatgtgggtgaactgtttgaggctctcacctctgaaggctgtgagacccctgatttcccactccacacctctatatttctgtgtgtctttaattcctctagcgctgctgggttagggtctcccggaccgagctggtcttggcaggctataaagacattttctactggcttaacagagaagaaaaacaaagcttagggagactgattatgcagaatttaatttgcaacaagcaaagacaagtctattgacttcaaatggacatcatcacattgtcatctgataatttttccagcatcctttgcctcctctgtgttaaattataaattaatgctgatttatacagttcagttcagcttcacaaatatttaatgagcacttgctgtgtaccaggtattattatataagtagttctttatggtgtaagaatggatagtagatacttttttatccattcaactttaaaaggttgatgcctagtcatagataccaggaaacacttaagtgaatgaggacaagttttctgctgtcaaagagagagatcagacaccaactagagtccaagaaagaacaaagtaattttgatcaacaaaactcatagaagaaaataagcattctttgttgttacatatacttcagagccattttagtgctcaaagtttgatagaaattgatacacaggacttgctgctctgaattggctatcccagaatattctacgagctacaaccagacctgacattaacctgtagttacttgtggtttattcatctatccatctaaatgttatgagcatctcctatgtactcttcatggtactagactttagacattgaatacggagcaaaaaagacatagtttcttatttaatgtggcttatactctgatgtagcatttcttcaccaggggtaattttgcctcaggggacatttggcgatgtctaaggacagtgtaggttgtcatgactgagatttgttgctgatgtctagtgggaagaggccagacccccttcacaataaagaattatctgaccaaaaaaggtcagcagtgccaaggttgagaaactcttccagcagttgaagaaaaataatcatcagatcacccacaagtataattacaaactgaaatacatgttagatgctggtagagctggtttccaaagtttctgatccagttgtgaggatacatattgatattgagaacgggcggttgaaggggcagtagtaagttattagggtaagaaggtcttggtgagcagagggactttcatgcgaagactccagggctcgaaggagcccagtgcagtcaggatctgaagtgacaggtgtggcttgagaacagcggcaatggggagttaggcaggaggggaagctggaaatgcaggcaggggtagacaataaaagtacgcaggccgtttatattatacaatcctgtagacttctttcttctttcattcttgatacttttctataataacattcaagcattggatcagcaccctttgttgtcttctgtcatgtagcccaaaggtttaccttggagacacaaaggcaactaagacaatggtttctgcactagggagatcatattctcactcagaagacatttgcagggtgtgattagtgagtctcacatacatgtcaatttcttcctaagaccttgtgcttttctagtttttatttttttattattatttttatttatgtattttatttgagagagcctcgctctgccacccacactggagtgcagtggtgtgatcatagatagctcactgcagcctccaactcctgggctcaagcaatcctcttccctcagcctcccaagtagctagaactacaaacatccacaaccacacccagcttattttattttttgtagaggcaaggctgtctctacaaattccgttgcccaggctggtctcaaatgcctgggctcaagcgatcctccggcctgggcctaccaaagtgctgggattccaggtgcgagccatcgcgccccaccctctagtttttaattggtttattttcttctcatatttcagttgagcattattcatttattgctgttgaggttttacttttttttttcttcccaaaggtagattgtagacagctcacctttgttaccaatttgaaatgctagatgttaattcttaatgttgtagctgtaaagggccatgatttgaggacgtgttatttttttaagcctgagtttggattggtctgagttgaatgcagttgctaagccatcgaatgagggagtgtccctgaactaatgagtgacatggaccttttcttataggtgagagtccatttgtgataaaggcattgttttaggatacataagggtcatggtgtatattcttagcaagtgttatgaatacattcgatctatttcttttgaattttagtgtttctctactctccatcttactaaaccaggtgtcccagatttcgggttcagcacatttgtgtctgggttcacatagagggactaactaggtggagtttagggtaagggggtattcagagtcctgccctcctgcaaccacagcaacacccccaagtctctctcattagattgtatttgttctcctacttatgttctttggcctctgctataaacattttcaaaaaagtatccaatgaaaacaatgttgtcaatgactgtctttagtaagtctgtagtcagattcatatctttaaaatatgtacactgtgtgaatatttcaaagtatgtatcatgaaaacaaataaggaaaaaaaaaaaaaagccaagaaagctgagatggctctattaatatcaggcaaagataccttcaagataaggattatttccaaaataaaagagagacatttcataatgatacaaggaagaattcacctaagagaactaataatgttaatttgtgtacacctaataagagagctgttaattatacaattagcaataaatgcaaagaaagactcatcaataatgacagttggagatgttaagatgttaccacaatagatgaaagatgaagatagaaaacacacacacacacacacacacacacacacgatatgaaaattttcaacagcaccatcaatgtccttggcaacttcgtacttcgagtccaacctcccttcacaatctaatacagaaacaaacaacccatgatttttctgcatttcgtggttaggttccctgtggctcaaggcctctggcgcaaatgatgttgtcttttagattttcatgctaagaagatactcatgttcgtatgtgtgtgctttttcctctatagcatccttaatgttggcctccagatgagagtctctgacaatggggctttaacatcaaacagccaaagtctctcagcgagttaacctctttggccttaaatttctcacataatgacatacaacagtccgctcttcttcaagtggcctttgaggagtctagggacacttgtgaattcacttccacaactcagctgcattgcgaattcaattattgtgctgggagatgttgtaccattatttttttttaaaggtgcatattctaaaggttaatcttgaggctatcacattaagggttaacattttatcgggggcattatagagtgcatttttgatggctgtgatttcagataacaagcttgttgtttctatttttcagctctagcttggcctctaatctgtagggaaggctggttcctaaatgcaggaaatgaggctcaatagaacatgaaaagccagtgttaatacaccattcaatctcaagaaagagtgggaggaagaatgacagagctgttttttgacagatgagtggttaggcatccccctagctctccaagtcaccactaggatgaactttcaggatgcagtgtcctgtggaatttggctctgaaacataacttcttcataaggcagatattgtaacgcagttctggattttgtacctacagacagctctgtgttatggtaactgttttctgttggcacaacaaacaattagttagcttcatgctgtagaatatttccagatgccctgatactccaaaccattggtcattgcagcctccatattcagatgtagcggctataaacaggtgatgcatgcatcctggccagggaccattttgatttttccacctttttctttcccaaattcagggtttgtccacattagcactattaaaacttttggggcgcttcctgtgcgttgtaagatgtttagcagcactcctggcgtctacccactccaagtctttaacacctaacgcccatccttaattgtgacaaccaaaactacctgcaggcattgccaagtggctcctgagggggcagcattgtcttcattgagcaccagtatggtaatcctagcctaatctattgtgttaccttattgttccttaacatatatggggtagaatcagaattacaggaacgtgaatttctttcaacaattatttctttacaattatgtaataaaatcataaaaggtaaaactgtatctttttagaagccaagaagcaacagtttatgaaacaaaacctcttttagtatttcatattaatcaatagatattgtggaaaggctagttcttctttaaggtaacagttgcttaagagttgaagtgcagcttatgagttttacaagccctgatttatgcacagcttgaggcattgttgttttgcaactattgttttccagcagcactgctattttataaaagcatgtatcagcaatagtatagaattgcatatatgcttcagagtcaatgcaatcattaaatagcatgcaatctgagtagagtctacccaaagctggaattcagagcgcatatttatgcacttagcaacattgccataattacacacacacacacacacacacacacacacacacacacacacacacacgcacgcacgtacttaaagccttagccatttaaaaatagaattcaacaactaaggctcgtacacatggaactcttttcatagcaggatttccaatgtgcaaatttgataaaattactctttttaaaaaaaaaattgctgcaacgtttttcattaacaccataaacatttacacatgattcaccccaaattgcaccctagatgtatttaccctgacttggcaatttcatacttcatgtctctacttcccttcatgcttcaatacagaaacagacaaccgatgacttttctgtatttctgtggctcaagtcctctggccaacctgataaatggcttaggctattcgataacctgcagcagatcctctgagatcttctttagaaatttcctccaagatcctaactacattcatttgtagaaatatttgagatgcaatgcataccctgtctagtatccccccaccccataacagaaatgtgaagtagggtgatctgtcatctttgtgcaggtcattgccagctctagcaccagaatctcctcacctggggaatatctcagtcccaggccaactgggacttggatactctaattctaggtgtggttgaagcatcggtgggttcctataacactggcacagggaaaaacattaacagtgggacagaatagagagtccagaagccagaagtgcatatgaatagagaagctggtcccagctgggaccagctttttaaccttgccaaatcttgctattgcatctttagcttttcttctttcctttttataccttcttccttctactttctgtttagtttcttctgtttttctccactaatttcttaagtgggatgattcactcattactttttgcccttgtgtttgttactgatgtcagtatttatggctttaaattttctctactgctaattttcctgcctcctgtaaattctaaaacacagtatttcagtatttgtctattaagtgttaagtgagatttgtgtgacgttctaataaacagttaatttttaagtgttttgtgtgtattttctaatgatgagatacaaaattatgtaattgtctatcaaatcatcggttaactgtttatggcatctgtttttcctattttttgatctattaaaattgaaaataggtttctttgtatcttccattaatgaatgaatttataaattcttcctataatactactgatttggggttttttaaagaacgtatgtggcataaaatatataacaagttatctccttgaagaatgaaatattttactatgtaatattcttgctatctcttaaaatgctttctgttttacaatagatatccaatattagtagaaatatgcttgtttcttttttacttttgggttggctattgctgagaatatattttttatattttcacctttagtaatttcagatattatggttgtatcatttcatatgacagatatctataatttctttttttcaatgtgacagtttcagtctagtaattgcataacttatgctatttatgagtttgaagatatttgatataattcaacgtattttaatctttcggatttccttttttatgcattccttttaataaatgagtttgttctttttctgtattttcttcttaatttgccatttacttgatttctacttttcaagaaaagcttgcagttgtaaaactcacatttaagtcattaaagtctaaaattaagcaagaccttagctccattctagaaaataccaatcacctgtctccctagttacaggctattattatgtatcatgaatatttgttataaactctttcagtttttgtttgattgaatacctttgttccctgctcattcctgaaagataattttgcttattatgcaaatccaggtggaccattatttcacatttcactgtcttctggctatacagatgtcagttggttttgagttaaactttatgcacaggttgtctttggcaagggctaaaatttaagatctcctgtttatttttggcattcatcagtttcatgtcaatattgattttttttttgctttatccattctttctatggtttctgtgcctttggattcatatatttaatcattatttgaagatcttagggatcacctttcaaatactgacacttctccattcttcctgttttctcaaattttgatttgatatatgagattctcatttttgcacccatgtctcctaaattgacttttatattattagtttctgtcttctgttttttgtaagattttcccagacatatctttttttattgtcttttcttctgtgtctaatctctttagctaatccattaatttctatttatttcaacaaatacagtttttatttatttcatttctatgtggtcatttttcaaatcttccttgtcctttccagtaatttcctgttttttgtttattgtttcctgtttcaaactttattttttaaatagctattttaataccacaagttttgtgtgcagcacctataatacctcagtgttcatgggcttagtgatctttgactgtgaactcatgtttgtttgatcttaatctgtgggaattttctggcctatgctggcattctttccccaggcaggtaggttcgctttccttctgatagaagctagagtgtaagacttgagccctttcaagggtccaaattctccaccttactggaagccaagcttgggtttctggccccagccccttgtcttacacatctggctgcccttccagctacctgctccctttgtctgaggtcagtgctactatgggtgtgttacataagggcagacttcccttaggtccagttttccctttgctcaggacacccaaatattcttttgcttacactgttggaggagctttatgtgggaaagcttaattttggatatttctcttacttccttgtgcccagaagttcactagcaagtgcatcttatcaggaggtaattgttttgttcagggaaggtctcccagagtgatgtgttacctgctgatgataggagtggaagcttttcctttgagaaggtttcaccaatggaaaaacaggaaggaatgagggagggagggagggaggaaggggggaagaaagaaaggaagaaaggaaggaagagagagaaggaaggagtaaaaaaagaaagggaggaagggagagagggaaggagtgaaaaaagaacaaaggaagaaaggaaggaaggaagtaaagaaggagaggaggaagaagtactgaggaacatcttactcaatggtgagacccagttcgtacatgttcttatcctatgagctaattttttctcttttgtttttcttaagagaattggctgtctcttactctgtaatacagatctgtgagaaaatagcttttataaaaagagattttgtagtattacacacttggcaggaatatagttgtctgttgtaataatgaatactaatctagaataggaggctgagaagaaaaatataattaaaatggtaatggctttttttttatgtgaatgaaactcatccagtattggttttgaaagatatctaagttctaggagcagactgtagcagaatctcctttaatactctaaggaaaggacgcttttagaaagtaggcattgcctccttatgtgaaaactgcattcctttcatgagggttccattttctggaacacaggatgtaagacaggagacataagaagggatcttgtagcagtgcagatgaatcaagtcactgcactttcttatttgatcttattttaaaaagatgcttccagggaagcaggaccttggaacccacaaagtctggagcaagtcattgacctcgcaaggtattcacgtcctcacagtaaaatggagaataaaattgctagtttttaaggatactcttaggaataaataacttgttatagcacatatcagaccatcagtcatgccagcctgttttcctttctctcttactctctccctctgttcattttctccatcttctctccaactattcctccctctctaccactgttgctccctccctccctccctcccttccttccttccattttttccttccttcctttctacatccctccttcccctctctttcttttcctttgcttccttttctttttcttcctctctctttttcctacaaaacagtatttgtcaactttggcactcatgacatgtggagctgatcaccccgtctttgttgtaggaggtgtcctatgcattgtaggaggtttagtttagcagcatgcctgggctctgcccagtagatgacagtggcaccactaccacaagttatgaaaaccaaaaatatctccagacattgtcaaatattgcctctgaggcgaaaccacccctggttgtgaaccaccactcaaaaatacacttcatatcaataaaaatcctgctttatatatatatgttttttgctcagttcagggttattaagattgtaagacactagtgtttttacaagatttctagggatgttctttgattgagtcttaaaatcttactgttgatgaaaaattgaaattatgttgttatttttatattccttcatatagcagcataaaacttggtattttatgggaatgagtatgcatcttgttctgattctatggtctacttttatgtgtctcaaaatgagattcagatcaaagaaaattaaaacgagagcaaaagtgaatattaaggtaaaggtatagcattctgattatctgctgcttgtccatctcaggtatgcaatactgacactgtgccactagtagcttcttgacattcttaagatgaaaatagtttagtttttatctaaatatattaatagagaatatacaatatatatttattcatatattaatactggaacaatagagtaaggttaaacactcaaaatttagctcaaccctgagattattatgaagtacttacaaaaataaaaactaaaaagacattagtagcgtacttcccagcttcatctctgcaggaggtgttaccttagctcagggcttggagaataggacatgtgtttacgtgattgactcttgttgggattgttctcagagctctcctgaccttggtccacacacttgggagcacatgattcctaatactgataaccacagtctcatgaatttttctcattttgcagaggagggaattgaggcactagatggtaatatctttttcatttcacatagttgctggtggctaagggaagctggtgctcagcttgtcccaggccatatctaagacatttgtctggccccttgctttccttcctttcatgcatacagcaagcatatccaacttttctatgctggtctatttctagaaggtgttatttgacatggcatcacctcctttgtagccctctgactatgagaatgatagaatgacctctcttttaaacctatctccttatccgccccaacacatacccctttggggtggggtcataagggggtatcccttctccacactaactttaccgacttctctcttcattgtctctctgcagcagataatgtaagcaagaaaaagattaagttaattacatgcacctcaagtttcagtaggaatatcccacaattcctctgtctcttaatttaactgttatttattgaacacctgctgtgttcttgggaaaattccaggtgctggatggaattagtttatgatgatagctaagacttgcagagacattaatgtgctgttcttcttcttcttcagaaagtatagccatgtacaaactactaaagggcgatatcaaatgttggggagataaatatcaaaatacagagcttccatacctgtagttttggttagtttaataggcgttaacatttactcattttcagctacctacatttattgagcagtgcctataccactcattgtaatttaattgcataataaattacactgtatttgctgtttatagaaatttagaaatttagtttaacgatatgtttataattttcttactactatggataatacatttaatgactataattaaattcttgcaaaatttttgaattgtttttagtaatttgccaatgattttcccaggtattaatttaatatattgaaattttgtctttatagcatagaggttttttatttcattcatttatttaacaggcatttatcattcatctgctttatgcaaggaaaaaaatggtcaagacaaggatgccaagtctttaacctcagggaacttacagtttatgtacagggacacatacttatcaaataaacagagaaaggaatgtatattcatatgaactcggcatcatatattcttctttatgttatcattaataacatccaaatgtcaacaacacatctattgttactttggttaaaaagctacacagacagtagtagatatggtacttggatgaagaaagctgaagtttattattttctctttctagttttaatccctaagggtcattgataaaagacttacacaaacccccctttagtaacctaataatgtataataatcctgttcttaaaatggtgatagagatttgcttggtttctactacataacaccataataccatattaagacttgaatctctttatatcatggaacaactcaggtagtgttacaaactgctgttactgaataaatgcggagaagaacaagctctccagagcagtgccatgcctgtgtctgatgtttcccaggatagaaaactgcgcagatgttgatggtttgtttcaggtgctttgacagcctgatcatgggctctagccgtggaccatgaaaaatggcttctgcaggggcttaagaaagacaatgaagagcttcgcattttctcttggcatttcctgctattgtttaaaaggtcacatatgcaatttaaaatgttccatgcatggagcatgacaaatgccacgtagaaaatgaaactgctttcgttgacatttttggccaatttccaaagggtaccattttccgccttttcccttttgtggatttgcaaaatttggcttgtgcaaaatgcgtgccccacggtgcactctaggttgggaagtgccacatgttaggtagaaaatcgtgtgtagatgagaatggcacattcagaataaaagtgagaaattaaatgacatcaaaaaaatagagaaaaatagagaaaaacttgtaaatgagtccatcagaactatcagaagctcaaaaagaaagaaaggcttagaactcatcaataacaatgtccagtctcattcatatgtaaagaaagtgaaatcaactttattttagttaattttactttattttattttattatccttttacctagctgaatggcaaaactcagttcagttatctttgggcatggaaaaatgagcactctcacagtttgctagttggaggaagaattgaagtagagttttagaagacattgggtattatacaacaaaatttagaaagagacccactttactcctctggaagcatttttgcttccaggaatctatcttacagatatatacacaaagatatatgtacataggtgatcattgcaactgaaatttttctcatcaggaagatgagtgaattattttaagcacttagaatattaaaactatctttcccttgaaattgaagaggcagagcaaaatgtgaggacacagagtaatattcacataaactccttaaacctatgtatgcacgtatagatacttgtatatatacatagatatgaatgcacaatagtatccatacacatatgtgtacatatgtgtgcatgtgggtgaatgcttatgtgtagatttgtatacaaatgtgtgtatgttgctgtattaaaaaaagtcaaaaaataaacaaattattaacaatgtttgcctcttagaaggtgactatggtacggtgcccttagagagaggctttgattggcagagaaaatgaaaaaccataactgcacctatatttaagattttaaaaaattctttgtagtgagtttgagtaacttttaaaagtacattgacatttcatttatgcagatcttctaggtgtgtataaaaagccatgagaaaaagatgatttcatgtgatagagaaaactagcacaggttagaatttggactcagctgatgagacagtatctgcccaaaccaatttaatcaaagctttgttgcatgagccgggtgtggtgagtcacacctgtgactgcagcgctttgggagaccgaggagtgaggatcacttgaggccaggagttcaagaccaggctgggcaacataatgagatcccttctctacaaaaagtttaaaaaatctagccaggcgtggtgactcaggcctgtggtctcagctactcagaagactgaggtgggagggttgcatgagcccatgagtttgaggctgcagtgagctatgatcacaccactacactccagcctgggggacagaacaagaccccgtccttaaaaaaatttgttttaaacacttcattgtgtggaagaaagctgtatatttaaacaaatataaccaaacccgtaatactggggagaaagattgatggattgttgaaaggattatacccgttaggccaattttgagatgtaggcaaggaatctcagaagttccaaaaagttctgctgtggttcagtgttacagggaaatctactcaagggaataatatatggcttgcaatcattttgcttttttgttacatttcctattattcattgcttcattgggcttgagagaagccccacagaggaataagaaataccctacatcattcacatcttcttggcttttgaaaattaaattttatatacttaaaagcagccatgacacatgaaaacattttctttcttcctcaaaccatctttacctagcctcacccaaaccaaactttaatttttacattaatttttcttttccaaagctatgcagctgacactcatctgctcacttggcataattcatttggtatccagtaagtttaagaaattctgtctgggcttcatgcaatcataacctacatccaaatagcaacacttataataacagtaataatagtattttttagtgttcacatggattttctcccttaattttcatgacatctcaacaaaatagacaaaatacatgggcttctcctcagccctgagctttgcctatcgttaaccccttgaagaaaaatggcgctgagctatcagtcagtcattccctggcagaaagggaacagaatcagtatagatggctttctgaagacattgacttgatttctgtcaccaacaatggcatattcaggctgtgctccatgccaggtgccgtgtgggcatggagtccaccacaccaggggaattctcagaagcagtattgaaaacacataggaaagcattacttaagcctgtataaacataagctctgtccagacatggaatacagtgggagttcttcctaggataatcccaaaaactaatacatcagaaagcttacctataacatgagaattcaaggcaaaggcatttttggtatgtaagtaaaatattaggttgaatccatctcttaatgcggatgttgaagaattaatgttatatccatgaagccagtgttgactggaaggactcaaaaaaatctgaagaatataaattccttgaccttctttattgaagacttcagctccattacacgaccacctcacagtcctcattcggttgccttttgcctgtttctgacttactgaaggacaatggtgtggagctacgatttatcacccagaaaatgattactaaagtccgtattctactctgaatactgaaaactctgaagtaatgaccctaacctaaacctcctcttcttctggctatcacttcttccttcccactttgatcactcttccatgaatcctggcaaacctcctagtactgagtatccttccagccaccaaacgtctgacatagatcgctggatctgactttaattctctcactaagaccctcaatttcctcctctgcttgtggtgggctcaccctgttgtttctcagctaagggtgcatccagatatcaatttcttgtgtcccatagcactgctagcattaagtgaattactgcatggtttggtctcattagtgtgtggtttccagaaacacttgagatcttactgttggcttgtaatctgtcttagtccattttgtgctgctataacagaatacctgaaactgggttgtaaaacatataaatttatttctcctagttccagaggctggcaagtccaagatcaaggcaccatgatctggcaagaccttcttgaacatcatcaaatggcagaagggcaaagagcttaagagagtgaacccactcctgcaagccctttttataattacactcatctgttcatgagggcagagcctttgttacctaaacacctgccattgtcccctctcctgcaacactgtcttactagggtttaataatattcatgtcaacgcatgaattcggggaacacattcacaccataggacaacccatttacactctctcctcatcggggtcaaagggcatcaatttaaggttttttgaccttttttgttttcattatatctcatttttatactaacagattcatttgttcgtataactctcctgtcttccagaatctgggacagttttccacctcccaagtgggatctaggagttaacccccaccatcaacccaagtactcctcctgtgtccaatggccagtcagcctcaatcctgtcttctcttgagttatgacatatttttctccttccattaatagtgaccattactgtaataggaatttatagttctttgtcctccagttctccaaaactggttctctatcctttcaattttatgctaacaaatctcattaaagtatgaccagtgatttctacattgccaaaacccagtggtgtctttttagtgatgatcctatatcaatttgatgggcactttatcacttgcagaattcttattccttttcattttatcactatgttctggttttattctacaattgtgagaagctcttctgtattttcttctcttattattcttaaatgttgacttttcctaggatttgttcttgacttcattctgtatattgtatgtctaggtaattcattgcatcttcttatcttcaactatctgcctctatgtggatgattctcaagtctttatttccagctcaggccactagcttcagttacagtgtttgtaattttagcccctattagaaatctctagttgagtgtcacatagacactccaaacacaacacattcaaatattaagagatgctcttcctctaaaacctattcctctctgcaccctcctgttagttaaaggtgccccatataccagtgtgtccaagatacaaactctgttggattttacttctcttttctcagcacttatgtaaatggatgtctacttctcatttctgccctgcagaacattcctagctatgtgctgtcttcctgtggcccactgtgacagcttccttatctcagtttagattgttatgcagtccattactcttctgcctcctaccttcaagctactattggagtcatcttcctgattctcacatctgatggctttcagtggctaagtgatgcattccaatctttcttagttcattttatgctgctacaacaaaacacctgaaactgggttataaaaaatagaaatgtatttctcatagttctagaggctgggaagtccaggatcaaggcaccatcatctggcaagaccattttgcacatcatcaaatggcacaggggcaaagagctcaagagagtgaacccactcctgcaagccgttaaaaacgcatcatgggccgggcgcggtggctcacgcctgtaatcccagcactttgggaggctgaggcaggcggatcatgaggtcaggagatcaagaccatcctggctaacacggtgaaaccccgtctctactaaaaatacaaaaaattagccgggcgaggtggcgggcacctgtagtcccagctactcgggaggctgaggcaggagaatggcgtgaaccccagggggcggagcctgcagtgagccgagattgcgccaccgcactccagcctgggcgacagcgagactccgtctcaaaaaaaaaaaaaaaaaaaaagaaaaaaacgcatcatggcaaaatctctttttttaccacctgggaaaacctaagacccttgggacagcacagaagactccttaatctgcccatgtgtccctttccagtgttagcttcttttactttttcttgtacacctcgtgcccttgccccttggaacaaacagctcacagttccctcagcacacccacccttctacctgcccgggagctgccttccgataagttgtatctcgatgacttcctccccactctccatctgggaagatcccagtcattcatttgttaaggcccagtgaaaaagattttatttattttccttcatataatatttttatgtatacatatatatgcatatgtatgctatctatctattagatacatcttgttttggcttatttttattttttatgttttgagacagagtctcagtctgtcacccaggctggattgcagtggcatgatcacagctcactgcaacctcgacctcctgggctcaagcaatcctcccacctcagcctcccgagtatctgggactacaggtgcataccaccatgcccagctaatttttgtatttttttttttgtggagacacagtcccactatattgcccaggctgtttttgaattcctgggctcaagcaatccacctgcgtcagccttctatagtgctgggattgcatgcctgtgcccctgtgtctgacgttatccttgttattttaatgcctacctcatttgtctttttcaaataataatcaacaaatgatttctggattgataaatgcatgaatgaaatgatagtttgccaaaatacagaatattaaaaccatagggtaaccttgagacaatttaggtaaaaaataggggattattttatattagaagattattcaatgtattattaaaatgtttgtttattgcatgtgttttaagtgttgagaatttaacagagaacgagacatgaatggtctaagtgtttatgcatcataataaagttgaagaaatgtagggttcccatggtgtttcttttcaaactttgataataacacttctttattgatcgcaactgtacattggcagcaccgcctccagactggaaaataagatcgatttctcctttgtgtttcttttataaccttgcaattttattcctcttgggcttactgttatgagtttggtttctagtttctagagcatgagttctaagaagtggaaatcaagatggaaggaagttactatagtgagagggtgtcatgccctgcaggctaggtatcttagagtctgactgcaactcccttgacacaggcagttctttttcttgcctgcagccctttccaaacaaatatcaccagcctcatattcccctcccctttatagatggagcccctttgtcaagcaggccagtttactgggaaaaggcccttctcagacatgctttctcatcctgatgctttgcctttaccaggagtgaggccagaaccttcagcatgcatttatatcaaaaaagagagatgtgctgttttcatttaaattccgcatttccactgggcatagtggctcatgcctgtaatcccagcactttgggaggctagggcaggaaaatcgcttgagaccaggagatcatgaccagcccaggcaacataatgagaccccgtctctacaattttttttgagaaagggtctcagtctgtcacccaggctggattgcagtggcatgtccacagctccctgcagcctcaacctcctaggctcaagcaatcctcccacctcagcctctggagtagcttggaccacaggtgtgcaccaccatgcctggataatttttgttttttggtagagacagggttttgccatgttggtcaggttggtcttgaactcctgacctcaggtgatctgcctgccttggcctcccaaagtgctgggattacaggtgcgaatcactgcgctcagcctctataattttttttttttaattagtgtgctagtagtctcagctacttagaaggctgaagcagaaggattgcctgagcccaggagtttgaggatacaatgagccatgatcacattccaccctgggtgacatagtgagacgctgtctctattaaaaaaataaataaacaaattataaattttcacatagtcgtaaacctctgaagatgtggatacttcatttgtcacatttaggtctttaatacactaataccttctcttgggaaacagtgtttctcagtctctcccgtattgataatgtttccactttgcccttgaagattttgtgggttatggggaaacagtttatggggtgtctttcagcagaaccacaaccctttttaggaagaagctaattatggtgtgaaagggacaggtgctcttattaggtagtgatagtaagagttaaaacccagttctcttgagctgttacttggattcttcaactgagggtgattttgcatctttggcactagatgtcattcaactgacagtcatggactcccaggggacccccaaactctatgtcacctttatgagtaggcgagaatggatttttcttggagaggagtgtctcctcaaagaagtctgtgacctagaagaaaagatgaaaaatctctgctttggattcggaatgtcaggactgttcacttggaacttaaggagagtttcttcctagtatatacgagactgaaccttatggggttgccattttcttagacccaaagctttcaaatacagtcattttcatatgacttctacttagacaataagatcatcatgtattccttttttcctctttcagcatctggcatttttctcctcttgggcttgttgttctggttttttttttttttctggtttctagaccataagcattcatgcattcacattatgttgcctcctaagttgtaagctctccaaagagagggaatatagctgctttatgtcttcacccaactttgagtagagatgatggcaggaaacagagagcattttcacagagaagatggagtccatttgagtcaggggatcttgtttgaaatcttacctgtgtgatctggggtgaattaatacagctgtctggaaaatttagaacagagacctcagaggattgcagtaaggagtcctagaagttaggatctcctcagtaaatataaatacttattctcttgggtaatgaagctgacccacaggatgatgccaattatttccttggtattataagcacataaacaatagttcacatttattgagtgcttactatgtgtaagatacaattatgtgctttgggatatgggttcacacatgaaacaagtgtttatttagtgcctactctgtgcccaacactggagatgcagctgtcatgagcactaacaccatcccaatatcatggtgctcatgtacccatgtgggaaaaagtaaagacaggctcaagcatataaaatagggaaggtggtcttaggataattcaagctggattgggatcagtagtgattgaagggctagattaaatgaggagtttaggacatgcatctctgcaagatggcatttgagcaagaaacataggcaagacttatctactttaattttcacagtagggtcatgagattacactgtttattaactctgttacagagatgtggaaactgagattaggatgattgaataacagccagattagtaatagggctggtagtctttaatgcaagtctcatgggctatgctgcacacagtcttaacaacttgccaccttccgtggtataagagaggaaccaacccaattcccgttgcctgccttccctgctatattagtctattcttacactgctataaaaaatacctgagactgggtaatttataaaggaagaggtttaattgactcacagttccgcatagctgggaaggcctcaggaaatttacaatcatggcaaaaggtgaaagggaaggaaagcaccttcttcacagggcagcaggaaggagagaagtgctgagcaaggaggaagaaccccatataaaaccatcagatctcatgagaactcactcgctatcatgagaacatcgtgggggaactgtcctcatgatctaatcaccccccatgaggtccctcccccaacacgtggggattacaatttggattacaattcaagatgagatttgggtggagacacagagccagaccatatcacttgccatctaattaccttgatcaactaccctgcaaccattccttagtgagtaatagggccacactcaggaatggttttaatagaatttaaaagttatcagtattgtagtttaattgtaattttaaaaatggtgaacctcacatcagtggctaggatcagcacatgatatgctgcatcttggggtcaataattgccgcaagcacattattagagttgctgttaatagtcatggaaaccaccctgtaccttcttcccccagtgcaaccaacctggcagtgattgacctactcggtagcgagttgctagacatcaggagaagtcagaagtaagtggaagaaggccaggtgtctagaagacccccccactacccatagcagtagcaacacatatgcataggaataggttaaatgagtcttcactcattgatccattcattcatctttcatccatgaattaactattcatgacccattgttgttgactctgaagatacgatagcaaacaggatgcacaaattgtcctgctgttactttagttatggggacagaagataaagcagtgatcaaatgcatgaaggacagaattgctgatggtgatcatagctttgagggaaatgaagcaacgataacatctaatgtgggttatgaggatctttgagatggagtggccagggcatgtctttatgagggtgaggaatttaagcatcccagacacaagttctgactcaaacatcagccttttaattatgtgaaagggtctcgcaaaatttaataaacttagtggtaggagttcaggtaacactacaagaaaccaagctttctttgtgaatggtgaggttagaaggggtttgttgctgaaaatcccatttgcaggttctaaggctggggatgaagtagaaggaacaatctcttgtcatttgccaatcaaagaacaatccctgtatctggcaaaagagacatacctttctatgaatcctggttttggtcataagccaaacttctatattagttttccctttttggttgagttagtgaacaattggatgattagctaaatgttgctgaaataggaggaaggcagattaaaaatacagaaagtaactcttatttaatgatttgaaaaaatgaggttaatccgacaaaattttaaggaaaagtgagataattttggtgtataaaactatgaaattttaggctgggcatggtggctgacacctgtagtcatagcactttgggaagctgaggcaggaggattgcttgaccccaggagttcgagaccagcctgggcaacatagtgaaaccccgtctctacaaaaattacagaaattagctaggcatcctggtgtgtgcctatggtcccagctatgagggaggctgaggcaaggagaattgcttgaacctgagagttcaaggcctcggtgcactctgtcctggcttgtagagtgagaccctgtcacacacacacacacaccacacacacacacagacacacacacacacacacacacacaaaataaaattttggaatgtaataacattgatgctgaagtgaattgtggaaaaatatcatataaaatatattttaatcacatagtataaatttctctctgtgcattagttaccaaaatttgaacataaacattttcaaatacacacttgtgcaaatgtcagggatagcaggtggtatatcactttttatatttaaaatgcatgtaggaatgaaaggaaaaaggtaaaaatatgttaagtgtagaattctaatgaaagaacatattggaactatgaaaacattatggaggactttgttcatttatggtctgagcacagatgatgctaaacatggtccttcaactttagctggcagccatttgaaatgaacacactaaacaccatgagaagcaactgcatgaaaagcaaagagagttatccaagtgaacttcatatctcatcatttgcctgtgtttatgtaatagtaaagacccaaggaattggtctaattaattggtattttattttagtgatgaaataatgagtgcggttgagcatgccagatgtattcatctgatacattcttccagtcacatggtaggctgcattaggtgataatgcttcaccctgcattcatttataagttagtgaagggaagtccacaactctggtctcagagcatttatcccattgttgatcagctaagctgttgctcttacttagctgctaaggaatgaagctaattggaccattccagcatgtaaaatatgtaaaatatgtcctttcatggaactctgaaacaaacaatgagaacaaccagaaaaattgccagagtcatacaaaagctgtctatttctaaatgatcattcctcaagctcttgtcatctactgggagcccctagatggatgtatagttgttgctgttgtggctgattttgataggactaacataggaccagtgtatggagctgtttattaagatgcttttgttgctgagtatttacattttgggtgttctcggataacatacgttaattcctactgcagtatttaataaagtgtaactagtgcctgtctcacctgtctgaagacattcaaatatggagcgtttgtttctttctctagtgcagatactaaatatcatattgtaattagagctatacagagatttagcatataggactggcaagtcttggaggccaatttttatgatgtgggaagaggggggcgtgatttagagtggacaaataaagtgtgggaaaattttgtgtttctggcttgagtgaccagctcttacctctcctccccatattctcttccttgcctcagtgcaaattcacactgtcttcattttgtatgatcaccctctgtcttagtccatttagttttgcaattaaggaatctctgagactgggtgacatatagaggaaagagatttatttggctatgattctgcaggctgtacatgaatcacggcatcaggatctgcttctggtgagggtgtcaggaagcttccactcatggtggaaggtgaagaagagctggtgtatgcaaagatcacgtggcaagagaagaagcaagagaatggggggaaggaggtgctaggctcttttaaacagtcagctcttgggggaatgaacagagcaagaattcagtcattactgcaaggctggcaccaagctgctcatgagggatccacctccatgactcaaacacctcccactaggcttcatctccaacattgggaatcaaatgtcagcttgatacttggagaggacaaacatccaaactatagcactctgtctccttaggtgcacctttcttcttcagtgactaatctagagttctctttggaaaatgcaaatgtagttatgtttcttttttgcttttatgccttactggttccctgttctttatagcatcaggttgcatcttcatcaactggggaaccagttgatgaagagaagatcagcatcctgaagtatcttgtaacttcttgaagtatcttgaagtatcttcaagattcagaatgcatgttaccttctctgcaaagtgctctttgcaccttgtccagtgtagctgtgttaactccagtgcaccttcctgatgatcttcctaaggctcttaccttcttgtcattagtcgtttctgtgaccatcttgcctataggaatgtgggctactgtgggcaagtacaatgcctggcatgcagcaggctttccagaaatgcttgtttggcttctagagttctctttgctgttaccacatccatccctttatcatccttttttccctagtcatctttcctctgtacctttgccgttggttctttctccatgaatcaatataaataatacaagctttgtgcatagcagaccttcactcttgtctcatgatttcatttctttcttcggcatactgaaaggcaagtacctttctctctctgactctcaatttactcatctgtataattttgatggttctttcaattgtctgctattgctgatgatggcacgaactcagatatgcaaagtatcagactttcactcttgtctcatgatttcattgctttcttctgcatacttaaaggccattaccttcctctctatgactctcaagttcctcatctgtataattttgatagttgtttctactgcctgccattgctacgacaatggcacaaactcagatatgcaaagtacctctgggttaaatgtgaacaaaaccttcaacctgctgcaagataatctgacctctgcttgactgtctagctctgttttcctggcagttggatgaagaacatggcaacaatattcttggccacattgcttacaatacaaacgatcccctatttgtaaatagcatcatgaccaggagaaaccataaagacctgaaagaacctagtggtaataccaccccacctcaggcttcccggagggcaagttttggagtcactttgcagctgctctgttcactctaggaaccatggaaactctgctcatggagtatttacagggaatattggctgctgtgaaggctgggacttcaatgccaaggaatacccaattcccgtggatatggaccttgtagggatctttgcatctcagctgtcctttgtggagcagatggttcccatatgcctgctgcagccttcctgatgagctgagcttcttgtctgtattgttttgagtcggttggcaccatggtaactttgggggggtcttgtgattctgcatgtttaatggaacctgagaagacccttactgggcattaaagaacaaagacaaatgtccctgtgacagaatactggctcaacaattggttttctctctgatgcctcttccctgcttggaaagcccttttcttttatccttcataatcacttcttacatctggcacagccttcagctttgcattattccttcattatcttttctcatcccacattaaaaaaaattctttaaattgtggccaaatgaacatgacataaaatgtaccattttcacatgtgcagttcaagagtattaagtacattcacattgttgtgcaaacatgctttttttcactctgtgccctcattttgctctttcctggtttccaatgcagtatcttatatatgatctaataaatgtgtcctgggcatctcagtcttgtatattttggtcctctgttatatcaggtacaccttaaggatagacattgtgccctactaatcttcctccttcatcacatgaaatattgtgcttgcatagtacattttcttcactcccctccctgttattttttatgtatatcatgacacttatttgccaaggatggctttggccctctatgcaaaatgtcaccaatgggaacaatgctaaagtctgcataaatcttaagtttaattctaattttaaatatttgaatatagtgctagtgttgtcattctataggattcattaattcatcccatcaacaaacacttattgagttccaaatttgttcaaaacatggccgtatgtgctgctgtagaaaaaatgtaaaaagtcagtttctagtgtaagggaaataaaatatggatatcattaagtcctggagaaggcagggggtgactgatttcaggcttgtaccatagggattcccaggaggaataagtaggttgcagcatttaagaagggatcatgaaagacatgccactttaactagttccaaatggaattttggaagcagagccattggatgttatagctgaagtaatattttaagcaaggtgtcagaacaggattgaggcataatttcagaagaacatgaagtccttgtttactaatgcagaatatgttttatgataggctggaaagtgaatctgtgactagatttgggagtgattcagtgtacaatgaatatggcagtaaagagcttggacttaattcgggctgctggtctggtcagcccttgtgtttggagagatgagtaacatttgcaaaggtggagagaaggaattggagattctagttaggtgctttgggcatatgttcagtgagggatgaggcattaatgttcatcaaggcagcattcacaagggctatggcggcactgaatgggagagcagacagacacaggtgtcatcccagaggtggactccgtatggcacagcggcaagggagtgtgaagggttatgacagatgctgagtaggtgctagcaacatattttttaaaatagtggcaaaatgtatgtaagatctataatttttgcatgtacagtttagggatattaacaatattcacactgttgtgcaaacatgcttttttcactctgtcctcattttactctttcctcatttacagtgcagtatcttatatatgatctaataactgtcccctaagcatctcagtcttgtatattttggcccactgttctatcacgtacactttgagggggcattttcagataattccaggtaaaacgtaaacctcacgatggcagctaagaaaacaggggcgttctctgcattggttagttgcagggctattagtcaaaattccaaatctcatatgcagaaggccaggatctgcagtcttaagtagttcagtttgtttcacggaggtaaataaaagaaaaaaggcatgctgaagatacatatccctggcctctagataatcagacagtaagatctctcccacacaccagagaaatctatttccagctttctgttgcagtccatgaaaatgacagaaaatacatgccctgcttggaccacagcctagctcatgggaaaaaaaaggaaaataaaaaagaacccgagcttgctgtggatggttcctatggagtgtttttggcactgtcagagtgcacactctgacaggctgggcatggtggctgacacctgtagtcgtagcactccatggcactgaatttacggtggaaggatcacattggcaagtcaaatccttgggctacaggaaagactcccatgtgctgcttttatgctccccagcagccaggctgtcgttcacaaagcactctccaagcatcttcatttaatgttgttgggcacaaggccctggtgaccccgttaaaatttaaatcttgctcatacaaagtgagggcaggttttcagttgacatttggaggtttctccagccatgttagaaacaaaatgcatttaagtgatgagcccttgatacataagaaggtgtagagccagctggatttctccgggaccatgaggggatccatctgattagggcttctgaagccgaaggaaactacagagagatgtaacttggctgactctcagttcattattttctcttggtaagagcacttctcatattggacaatcttttcttcactgatttagatattattttagatgcaccttttctttttgttatggaagctttattttaaaataaagttaacctaaaatgggcgtattactctccccccgccccaccgctaatgatttagaacatgaaaataatccacaagaccatgggtgctgtcttcagctacaattactactttcttaattgtcatggaaacatgatttattattggatggttttttactgtcttatgcaaagatttcatatgagccgcaatacacactgtttcatatgggtaagtctcaatattatctgacaaagagagcttctctgcccaagtttatgaaaagtacatttttttttaagtcactgtcttgcccaggctgcagtgcagtggtaccatcatagctcactgcagcctcaacctcctgggctcaagcagtccgctcacctcagcttccttagtagctaggtgttttggtttggctttttatccccacttgaatatcatcttgaattgtaatccccagatgttgagggaggaatctggcgggagatgattggatcatgggggtggtctcccttattctgttctaatgatagtgagtgagttctcacgagatctgatggttttaaaagtgtctggcaggttcctccttcgcacattcttctctctcttcccaccatgtgaaaaaggtccttgcttccatcccgccaccttctgccatgcttgtaagtttcctgaggccccccatgccatgcggaggtcaattaaacctctttccttcttaaattacccagtctcgggtatttatttatagaagtgtgaaaacaaactaggacactaggactacaggcacatgccatcacggccagctagtttatgtttattttttaatttttgtagagatggggtctcactatgttgctcaggctagtctcaaacttttggccttgagcagtctttccacctagacctcccaaagtgttgggattacaggcatgatccactgcacctggctgaaaagtttctattgaatggaaagaacaatgctgtgaaaatatattttattaatgttcaggaaattgtggaacttgaaaaactctagctttttagcagttttaatggctactatgtgcttctaaaatttgtacctgcttttttgaagtgttatatgcatttttgtttgttgatggtggtgatgtttttgccgttgatctcacctgctaacgtggaaacatttcaagaagtggaaaaatgtcttattttagtacatactatggtgtcagctacattaaaaaaaaaagccttaaagaatgtagcttgaattgagggttgctatgactttttgttgtagtagatttatgaattgtgtatcatcattttccttcagtggaaaattcagtaactagtatgttactggttcctggattccaagggaggagaacatgaaacattgcaatggaattaaactccaatgagcttgacccagctacgatgttgaagtgagggaatacataaagacttgggtgtatgtgtgtgatctgttggtattaaagtgccaggattacaacattctatgaaaatggctaatcatattcaatatttatttgagacgcttaagatgcatggtttgggtggaactagggttagggggctgctgttttgaacagccaaactagaattctgctcaattatctcacacaggcacacttctgaggcattttttacatgatgcctcaagaaagctttgctccattttgtatttcagcatgaatacaaatttttgaaatttccacagtaaagtgtttagacttaccaaaaggtaggccttgttataataacaccagtaggaccgatgtagtcatttctaaaatgattcaagcactttatgtttctggatgagctattagatcttaccttatgtgtctggataagctattagatcattacatattttaaagtgaatttttgaaattgttggttcattgtttaaattttcaattttgtttctgttgcattaatctctgagatttgaaaatgagaaaagaaaaaagatggatacacattaatgcttttataccttcctttgtaacagcaattgattgtgcacttgcttttggctgtagttagtccttttcttaaattagtttctggtatggatgtctacttttatttaatttttttttttttttgagacggagtcttgctctgtcaccctggctagagtgcagtggcgcgatctcggctcactgcaagctccacccccgaggttcaagcaattctcctgcctcagccagctgagtagctgggactacaggcacctgccaccacgccaggctaacttttgtatttttagtaaagacggggtttcactgtgttagccaggatggtctcaatctcctgacctcttgatccacccgcctcagtctcccaaagtgctgggattacaggcgtgagccaccgtacccggccccacttttatttaatttttattcaattttacattttatatgccttgttacttcatttcttagcaccagaactacaagtttaattcttcagacatcttctctagcacctcataaggtattctttgttacttggtgatagagaactatgtaatttgattttcttcttttgcaatggagtgttcaaatacgtcgttgcttttaggtgagggatgtgattaattagaaaaatgagtggatcttagctcaatgaaatttaatcagcagaatggaattttccattcagagcaaatgagttcctaggactggacacacctagatctgctgacccaaaaccctttatagatttcatttctgaatgagctattagatcattgtatattttcaggtgaatttttacaattgttgattcatcgtttaatttttagttttattttctgttgcattaatctctgagatttgacatatagaagaaactctcatgccagccccaaacgctttccctatctcctcctcccatgccttcctggagtggagggaacgtcaggcataagcagagcccaggagacactcatagacattctgagaaagcttttctctgtagaagggaccaacacatcttgcaccctctccctctcttgccccctgcctgcatgtgggtgcaggtgcttttgtcaggaccccactgcttatctcaggtcaggagctggcaaacctatgaacaagatggaaacccaactgctgaccagggtggtgttctgacaggagagaagacttgagcccttatagacactgttgaatcactaagctgtaaacaattttctttggtcttcttgtctggtaaaatcaattctctttcatcctttttaaagacctcagtttgggctttagaatccatactggcaaatgcttcctcactaatattgtgagatttaattagagatagcattttatgtgctcacctaaaactatacggtagacacaaaggagtctgggtctcagatcccaacacgtggattatagagaaggcagaatgctataatgccttgagggtgagccatccattatttggggatttgaaaaaggacaatttctgttttatgtttctgtcctcctaaatggagttgagagacagcttcttttctccttagcatttgggcaagaacagaatccagtaaaaccactgaggaaggtcatcattgcagcgtttatttaacatgagtaattctagcatgagctggcatgccatttacatccatctgttttaagtgtttgcaagcagaatggtaataagaaactggggtaagtgttaaaaataattatatggaatatagattgccccagatgcactatctaatgctgatgggaaaggagagagcagggggtacctggaacctggacttctccttggaaacatgccatgaccgggtatgttactggattgcataggtgcagaacatggaacattgcagtggaattgaactccaatgagctcagcccaactacgatattggagtgaggaatgcatgaagacaaaacctttattataagtctgtgtgtgtgtgtgtgtgatctgttgggattaaagtgccaggattacagcattctatgaaaatggtagtggagaaaaggaaaggtagaggaaaagagaaaaaccaaagcaagaggaaaaccactggaagaaaagaagatgggaaggagaaagggcatctctgaagaatgtaaggagtacaagatcccttacaggcagtgaacacataagaaggcatcattcaccagaaagtcataccagtttatgtattaaaactgggaatggcaatgataggcattagttagagattatgctttaaattgtatgcatttgcatatttttatatgttttatttaattttgttttgggggggggactgtatctcactctgttgcccaggctgatgtgcagtggtacaatcctagtttactgcaaccttgaactcctgggcttaagtgaccctctcacctcagcctcccaagtagctgggactacaggcatgtgctactatgtccaactaattttgttatttttttgtagagacagggtctcaatgtattgcccaggctggtctggaactcctgggctcaagtgatcctcctgccttggcctcccaaagtgctgggattacaggcgtgagccactgtgaccagcccttttgcatatttattgtttttgtttgtttgtttgttttttgagacagagtctcactctgtcacccaggctggagtgcaatgacgcgatcttggctcactgcaacctctgcctgctgcgttcacgcgattctcctgcctcagcctcccaagtagctgggattacaggtgcccaccaccaaacccggctaattttttgtatttttagtagagacaggatttcactatgttgggcagactggtctcgaactcctgacctcatgatccgcctgcctcatcctcccaaagggctgggattacaggtgtgagccactgtgaccagcccatttgcacatttagtgtttattttcttaatcagtatcgaaactgtgaaagggaatgttaaaacggtggagccaggtgaaaaagaaaatccaagagtcagaagagagcatccaaagaagaaggcagaggcaataacaagtagactctgagactgaaattaaactgtatggctagaagatgggctagcataggacaagatgaggtaacatgctaacatggaagattgagaagaattgcaaatgagaaatcacggataaaacactgaccgcctaataggataaaagcagaggatgttcataagcagctgtcatcaccaaggaagaggaaaacatgggaaaggttttgccctctgagcagaacaatcctgcatgtcaagggggagcctcatataccatgtaacctcatgttaaaccataaatacttaccaatacctcttacagtgtgacaggacacaaactattaaacctgatgcagataatgccttttaaaatgagtattatatttgattattatttctaataatgttataactatgtttaaaccatccactttattccctagatgaaatataattgaattaaatgttaaacatatttgacatgcatttctcggggcttttgatttaacattttaaaatatgcaatttagctattttaaaaaacagtcttaaaaaataacatagtatatcaagataggcagaaggaaaatttaggcaccaaataatagagtacatgtttcctattatgtgttttggttgggagatgatctttggaaagtgctgattctgtttttgtttccataaaacaaaatttccagagattatatattggattctgcttgaaagagttcagtagacattgcacttctatcacactgatagcccaggaggaattttaactatgtaattatttaaccgcaaaattttccaccttctccccttaaacatttggcggataaattatgataaaagcagtcatgatatgcagttcggtttcatagtttcctttctcttcctttttgctatatttcctaaagttctattatggagagataccagttttaaatgtcaagcaatgttaacatctttgcatctttatcttttcctatccactcttctctcttttcttttctttttttttttaagggccagagagtgacacttagccaatacttaaccagtactctctttctgtttgtttgtgggaattttatatctattttttctttttcaatttttattttaggttcagagggtacatgtgcaggtttgttacatgggtaaattgggtgtcgctggggtttggtgtacagatgattttgtcacgcaggtagtgagcatagtacctgataggtagttttttgaccctcagccttttcccacccaccactttgaagtagacccttgtgtttattgttcccctttttgggcccgtgcgtcctcaatgtttagatcccacttgtaagtgagaatatgcagtacttgcttttctgtttctgcattagttctcttaagataatggcctccagctgcactcttgttgcttcaaagaacatgattttgttctttttatggctatatagtattccatgatgtatattacaccacattttctttatccagttcaccgttgatggccatctaggtggattccatgtctttgctgttgtgaatagtgctgtgctgaacatgcaggtgcatgtgtctgtttggtagaatgatttatattcctttggatagatatccagtaatgagaatgctgggtcgaatggtagcgacttgtctcttaatagtttttactttgcctcgatctcctgattctctccctttttttcctggccattcccgctgcacttgcctcatttgctattgatgacatgcttgtcccctgcttccatagatgtgtccacaaatgcatgtgcacacgtgcttcagctaaagattcctcagctaaagattctccctctccatcagggtttctctctttagctcacctgcccttctctacatggttttaaagtgagatgattgtaaatgtgtttttcacaatggaaattctcccagcgggcggggaggaaaaaagacatcttgaaatattttctgagaactatgaggaccggcagagtttgacatgtttttgaggcgataaagtcatgtgtccatctgtgaaagacaggcattggctttatccacatccacacagccttccccgctgtgtggcttcattattgatttgctgtcatgtagagtcgataatgagaaaacctaggtagccttgaacccaactttgcaagaaccttttaggactctgggacttctaaccctctaggaaggtggagttaaggggatataggcacagaatggggcagaagggaaagacattaagagacagcctttagcagaccagagaatacatgccgtttatcaaattgttagatgtctgtgcaccaggaatgttgattcaattatggtatctaaaaataggacagaaataaggaggaaataaaaggaaatgaaatagcagtttacctctggcaaaaacaaagagcccaatcagaaaaactagacaaagccacctgtaggactggaagaaaccatgtgagttaggtatcactaaccttggaaggacaaggacttcctagtatttttgtattttgtgaagcactttctctgcattttcttaatttgtccttaagtgattatctctcaaccaaccccaaaatttgactcttcaaatcatttattctctaagatttttaagcattcaactgtaatggcttatgtatcagcatagtcttatataattctaaaacaacattcatagcatggtatcttgtaatatttgactttcactattaattctttcagttattatttgagtgcctgtcacatgccaggtattgttctaagcttcagggatgcatccatgtacaaaataaataaaatttcctcccttgtgccactgatattctataggtggatggaaaacaaacttaagagttaaataaattaggttttatttaaagacagggtcttgccctgtcattcaggctgggtgcagtgtttaatcatagctcaccgtactctccaactcccgggctcaagcagtactctcacatcagcctcccaagtacctaggactacaggtgttgccaccatgcccagctatttattttctgtatgtttttctttttgtagagattgggtcttgctatgttgcccaagctggtctggaactcctaggttcaagcaaccctccctccttggccccctaaattactaggatcacagacatgagccaccatacgtggccaaagttttgtattattttataaggtgatgagtgctgtgaagaaaactagaagaggataagtggaattagaattgctagggaagttgcagtattttaagtagggtggtcaatgacaacctcaatgaaaaggggatgtgggagtagagaattgaaatagctaagggaaaaagccatgatgatatatgagaaggatgttccaggcagagggaacagccagtgccaaggctctggggtaggaacatccctgttctgtttagggcagagcagtgtattagtctgttctcaagctgccaataaagatatgctcaagacttgggaatttataaaggaaagagttttagtggactcacagttccacatggttggggaggccttacaatcatagcagagggcaaggaggagcaaagtcatgtcttacatggatggcagcaggcaagagagagcgtgtgcagtccctttacaaaaccatcaggttttgtgatacttactcactatcaccagaacagcatgggaaagacacacccccatgattcagttacctcccatcaggtccctcccacgattatgagagctacaatttaagatgagatttgggtggggacacagccaaaccatatcaagcagtaagatccacatttctagagtatcagagtatgccatcagaatggcaggtatcagagtagggtggtgctatcgagaactttgtaattctgagaaccagggagaacaaatggaaggatttcaacagataattcatgtgtcaaggtgtgttttaaaggagcactttgcttagctgaggcttgtctgtaggggcaaaggtggaatgtgggagaccagttagaaggctgatgtaagagtcaagataagaacctacagctgggaggtgagaagtggttggagttttttatacatttgaagtaagatttgctagttatatggatgtggagtgtgggagatcgaaggaagtccagagtttttggcctaaacactggaaaaggtagaggtggtcacaggtgacattggaggatgggctagtagagacattcttaagttatcatcaaagtttaaatgtttgagtttgaaatgtctatgagacatcaaacggaagatatcccataaggagatggatgtcagagtctgaagttcaaggcagaaatctgtgctgaagagaaaaaatgtcagcctagatagtgtcgatggtatctaaagctatgaggcggaataaaattatcaagagagttctgtggacagagaagagaaaggaccaaggctggagcttgccaacaatttgagattggtaataatacgaggaacctggaaaggaaatgaacataattgtccagggtgtaaaagaaagtctggtaatgtggaagtgaaggggggaaaaaggcatttcaatgacagagaggtagtcaactgggtgtaattcaaataggtcataaaatgcacatctgctgctatggtttccactacagatgcaaggaaaaagtgtcctcgtccttttgtctgtctgattgtggcagttgagattgaatagaggtagacagaggggaaaaaagaatgaggaaaattgagaacatagcaatgcaaatgtcatttttgacctttagtagaaaagtaataattttggtggagtgttgggggtaaaagccccaattggggcaggtttcagagagaataagagcaataaaattggaatcaatatcaataaatattttcaaggatattttcagaaaaggaacaatatagacacacttttttttttaagatgagaaaattgttttattgcttttaagatggaaaatctaaccacatttctgtgtgctgtagggttgatctagaggcgtggtgttatcaatcagtacagtgtatagtgtgctacattaacaaatatccctaaaatggcagcgacatccacagccactaaagttgatttctcgctcatgttcaaagttcgctaagggttgactgtggctgttttctgtgtattcttaattctgggacccgggctgatggagaagactcatttattcttattattactaattatttttgttattttagcaaagggggaaaatgggcagaaccacattatagctcttaaggttttcgcttggaagtagccccactaatttctgttcatgtttcatctgccaaagcaagtcaattagctataactgaagtcatggaagtgagtcagtgaaattctttcgagttagggacagggaaagtcttgcaagtgtgtatttgtccccttgagaggtgtggacagttttttacacaataatacaacatacaagaggaagacaattctgaggatatagcaagagcaaggtgttctattgttgggttgtcaagagttgatggagtttgatgggtgagagtcagccttatattgggttcctatcattattctcttatgaaaagaggaggcacaaaagatggggccattattgtcacatgggtaaatgggttagtggtggtttgtgcatgttttcttgagatagaatttcttcagtgtagtaagaagccaggtcatattctaacagtgaagatggagcacgagggattggggattagaagaggaagaagaaggtgctatttagcagagcctttaagggaattcatcagagaaatttagtatgatatacaggcatctcgattaacctactggaggtttgtgttcatgaatttaatgtgagataagtcagcatgattaaatatcttctttcatctgtgctgatcagtaaaggtgaggcggatgcatgctgggtggggaggtggatttcaccagggttggagttttgccaaggaagaatcaagaattaaggctggattagaattgagggtgtctaaaggatcgtggatctgctatgactccacaactctaagaaaagaagattcggtaccaccatcctcattatggaaataacaaacgaatgaaacaaaaccatttgtcactttctacaagattcagagggcttgtatgtctatgatctcaggcctcaaaaagagtaaatcagttacctttttcccacataactctgtgtgtgtgttagtacaattttgtatgtttgccctagaatgtgaaccatgaatttgtgaaatgaaagcagtgaataggaaaaaaggtaaagatacagttttgtattatctgtagcaaaaatattaccacagctatgtaatccacaaaaatggaagaaatttattaggtatttaatttttatccaagagtagtaaaatgaaggcagctatataattatgtaggtgactgttaaaatattagactttttgttgaaattttttggctcagaaaacaggtttcatgccatgctgaaaaattacttagtttgatgaaaaagtaaacaagacatgacagtgaaatcatacagtgttgaaacaggaaatagctaaaatgtatttttctcagtaaataagtggctggcataagttgtcctcattttggggtcaagatcttattttggtgtctcagctgaagatgacctcttcacaatccattaggtattgtgacactgattaattattatcaagcagaaagtattttttggaagtactttgcactaggcaggtaaggcagtcgctaccacaggggcacaggtttcgaagcagttcaggaggagccaacgtcttgctgagaaacccaaggcagacagcaattagaggataagataatgtataattaactgccaccgtgtgtggggtagacaattagagaacaaggcaacacagatgttgtaaggtgctgattatgggttttaacaataatgaaaaatggaagacaacatcatcagcgtgggctgacgctgtcaggggtggtgtgttttctcatgtgctgttaccctctaatcagtgttgagttggatagtattcccaggaatggctgtttggcttcgcttctcttaccagagaattgctctgccttataaatgtagagactgacatgtagacacacttggatcatgaatttccattctactctacaagaagtacagctgcaaagaaaatcaaatcatgttcagtacctttctggaattttcccaagtactcagtagtcattctagctcacatcttaactctgctagggttcaataagtataccaaatgcatatttttttttagctaattccaaaatctaattcactttgatcaatagtcatctcctatgaattccttgtgttttcttcactataaaatatttttgtgattcatctttcagtagacgaaaggtgaggtactttgagattatatttctactaaatcatgaatgattcattattttactgaaagtaaacacatccatcatattaaatccatatcatgttctgttgtatattgtcacttaagtgtttttattatttttaaacaggttgtataattgcatagagcttcaggctatctacatagacaaaatatctgaataaaagtacaacgatcatattttatcttgtcagtttaaattatgtttaatgattttaattccagggaaaactctaatgtaccaagttaccaactgaaatgtgcccagtatcaatcctttatttttaaatataacattgtaagttgttaagtaagttgttaactcttatccctaaaaagacataatgttcccttttcttatcatatgctaaaataaaaatttctaacaatgaatgtgccatttttataagccagcaaactatgcaagtaaggatctcaatagaagatttaaacaaaataattattttgctccatattctgttgcttttgttttttgatgagataattaattttcatggaattttaaatgatcaatttgtagtaaattttgggaaatatgtccattatttaatcacagatttagtatcttaaacacattgacaacgtcaaacttgtctgcagcaaatggttactgttaaaaatttgccataggggtgagaactgcaatttatactatttctaagctatcaatgcttcaattattacatgtgtttatatatatatgtgtgtatgaacatgtgtgtgtgtgtgtgcatgtatacacaaattttaaagtaatggcttactgaaaggcctttttttctcttcatatgactaagatatctgaaattctgcccaaaattgctaagattatatacccttctgaaaaattgcaatgtgtttatgacgtatttttatgatatttcagtaccggatatgttcattaccccatgtatgaagtcttatcttgtgatgatgagttgatcagacctattacattgagaatatttttaggtataaactttatatagtctctgatggtgagtgtgtaggtaaattgctttgggctcacctgattgtattttcattgttgttgactttcattatttcactaatttgggagcaagggcttcttttttatggtctatttctagatcatcttcccttagattacatcatgtaatgaactggcagaagatattaagtagatcttattcaaacaagaactttgaacctaaatggagatttatcaagctaaattagcctaattgtctgtaacaatgaccacagcatattaataaaacctgtgacccttacatatatacatgtgcattttaatgttcttccactatgaaaggcattttgtgatttaatctgcttgatgaacgattaatatgatattcactaatttttactcatcttattcttaattcatctaatttatctaattcttagtaatctaaatgattcaagcctcttacagatttttatctctacccagtttttcatccagctgtccgtgtggtcatctctgccttggtgtgcttgagaattatttctgattctatgacaccaatgcactttgcagtctttgaacttgaattggcagaatcaagcttcctctagacaaatcactgaatctcttttctcacgttaaggtttgtaggaaccctattctcaaagctgccaaaacactactgcttagtctatgcaaatcaacaactacaaatgcacgtcactcaatcaacattatgaaactcctttttggaatgattgatgatcacaaaatgtgatcttgtgacaatatgatatattcatttaagccacattgaggtttcaaattggcaccattgacaacgtacctctttcatgctaagtgtaataatttgttgcctctcattttcctatgctgcttcacttcattaaatctgaataattaaaaattttcgtagcatcgccaaagtcacttcccaggagctagggaatgtgtcgatctgtacactgatccagttcctgctgacgtttgcttggatgcagaggccatccatcgctttccattgatttttgtcaattgatgcttttcttccttctttcctggtgacttaggaaatgttctgaaactgtgcattcaagtcaacacatgttagattcataactaggattcaccttcacagtggactggtcccaatttgctgtatttttattcagcctgtcaactcacactatctgactaaaagacgctaatgcagtgttggccagtcccctgtcatctctttctaattgtttggtctcaaagcaatggtgcatgttacacatatccatttaactgtccaattaacgcatgtttctagacaattctgatagaaagggtctcttttcttccttcagcccaaacaaagcaaaacaaaacaaaagggcacttacacgatgttgatctatgttttatctttttttttttttgagatggaatctccctctatcaccctggctggagtgcagtggcgcgatccccgctccctacaacctccgcctcccaggttcaaacagttctcctgcctcagccttccgagtagctgggactacaggcatgcaccaccacacccggctaagttttgtatttttaatagagatggggttttgccatgttggccaggctggtctcaaactcctgacctcaagtgatccacacaccttggcctcccaaaatgctgggattacaggtgtgagccaccacccctggcctgtttttgttttatcttaaatctcttaggctgagactcatatggtcccacttacccatctttttacagcatgaaattgtccagttaaaattacagctctttattaatggccttaagactcttcattttgaatggataaaatagtaataggctgtgagcaccaacagtattaatgtatcattcatgcatgatatagtagtgttgacatctttcttttccttttctgtttttaaatgaagttcaggaaaccaatatgaaaggtaagaaattgccaacatcttggactatcaaatcatggcagacaatgaattaaagaattcaacaaatctttggcagcatcagtttcaaaggtatttagatacaaccaccgtgtaattctacacaatttaattaaatcatttatcaaatcctctacaacttgaataatttaactgatatcagaataatccatttttcagataattatttttatatttaatgtgttaaatataaaaatatgacacttctcttgcataatttgcagaatgttatttatttcattattttattattatttttaaaatttcaacttttatttgatacatgtacagatttattaaatggaaatattgcctgatgctggggtttgcaggaaggatcctgtcacccaggtagtgagcataacatccaataggtagttttgtaagcccccccacaaccagcaccctatagtagttctcagtgtcttgctcttttgcccaggtgcaatcaaagctcaccacagcctccaactcctggactcaagtgatcctcctgcctcagcttcctgagtaaataggactacagatgccaccatggccaactaattttttaatttttactttgtagagatggagtattgctatgttgactaggatgatcatccactcctggcctcaaatgatcctcccggctaggccttccaatgtgccaggattagaagtgtgagccacctcgcccagccccaatgcttgatctttaagagcttcaggcagttgaagggttttgtctgcctgccacagccttccatctttttgagatgtgtttacctgagacagctaagtaggtgacaacctgaactacggttgctggcaattggaaaacagaagattgctctgttgatccattgggagaagtacagtagtctgtagaggaacagaatcccagggtttttttctggcatggaatcactctagagagccacattaaaaatttaattcctgctgagcacagtggcttacgcctgtaatcccagcactttgggaggccgaggagggcggatcatgaggtcaggagttcgagactagcctgaccaacatggtgaaacgctgtctctactaaaaatacaaaaattagctgggtgtggtggcgtgcacctgtaatcccagctactcgggaggctgaggcaggagaattgcttgaacccgggagatggaggttgcagtgagccaagtttacaccattgcactccaccttgggcaaaacaagcaaaaaactccatctcaaaaaaaaattaattcccctttgactgttgattttatttatttattattatttttttagagacagggtcttgctctgtctttcagattggagtggtatgatcatagctcactgcaaccttgaaatcctgaggtcaagtgatcctcccacctcagcttcccaagtagcttggttgacaggcatgcaccactacacctagctaatttttctatttttatttttgtagaaacagggtctcgctctgctgcccagtctggtcttgaactcctggcctcatacgatcctcccacctagttcttccgaagtgctgggtttataggtgtgatagtgccgagccatttggctgctgtttttacatttataccattatcttcatcctaaataggaattctgatagtattgttggcagaatagggtcaactggaacacacatttttgttctctaggtaaagatgatgaaacttaaaatgtagctaatgttattcctgcaatgaatatgtcaatttctaatctggggacaaaaataaataaaaaaaaagttgcacgtattaaacaccttcttgactaagtggcagctgtaatgatttcacttggggatagccattgcttcttaactcatgctaacagtgcattaaagctattgatttttagtggctgctgtgctttcgtgattgtagatcatttctctctttggaaactctatttgatgacaaagctggctctgttgcagagtaatgataaaagaaaggacctaccagaatttcaagtgaaatgtataacatatgtgataatgcatggtgactgcaatgattatttcccgatgttgctgtttaatagccatgaaagcatcctactgaaatagagtatttctgctttgaatggcttagttagctcaaaaattttgaaagctttctcagtaaagcatggtgccaggcactgaaagattccttttggaggagccagagtcaatttggatgatgtttataaaatgctgctggaaaattgggtggtgttttctaaatgatcttcctagtaatgatttatgctgtaaatcagaaaggttgccatctctctggatggaaatgcatagtcatatgcccgtaaatgcagggatttgacctcctataaaaaagctctctcttccccctcatttatgtgatgattgtataccatctgagcgctgagaaacccattggccatcttccacttgtgtgtggctggaggtgcttgctgcagctctgtgatgccctgagccagcatgctcgtggagttccagtctgctgcatgaacaagtggagaaacatgatcttcctaaactgctcacaagctgctaaatgagtgatttgtgttccctttcacctagttccccaaaacggggtccattagctatttatgctagtgctctcccttccccccgcctccctgacagaccctagtgtgtgttgtttccctccctgtgtccatgtgttccaattgttcagctcccacttatacgtgagaacatgtggtgtttggttctctgttcctgcattagtttgctgaggataatggcttccacctccatccatgtctctgcaaaggacatgatcttgttctgttttatggctgcatagtattccatggtgtatatgtaccacatttgctttatccagtcaatcattgatgggcatttgggttgattccatgtctttgcgattgtgaatagcgctgcaatgaacatacacttgcatgtccacattgagaaaccatctcacgcaagtcagaatggcgattattagaaaactcatattctttaataacatctttgaaatgatgattcttcagtcttgaatcatcagtgcttccaggccataccttccccattcttaacttgaatcctgacttcattcttgagcttgttggagttgccctgagcttgatttcttagagtgaattatcctgtgatttttactctatgcctaagttagatggactttcttagcatgctaatctctaaaaataccttttcaaaggagagattgggaaaggttttgtaccaaaacatggtagatcttgttccattatcaactgcgtctcgtgtcagagagttctaaggtgagtgaaattgtgcgtgtttgtagcgtggtcataaagacatttcacagagtggatcgcaaacaaaccaacagagcacagagggcttgagagcaatggcagctggtggaagcacaggacagggcacagcgggaatttcatgggaccacgaaccaagaacagaacccatgaccaggctgtttttccttccaggggcccaggctttctcagctcagccttcacttgcatgctgctttgagcatgtttggcttctttgagaaaatgagccacccaagaggcctacatccaagtcacctgcactcagatcccagccaggagtatggagggcccatgtggggtggagtggtgcacgtcctcaccaccttagacacagggaccacctacctcattttagatggagtgggcagataatctgcacacatacctccaaaggtgtcctctattgtagagacaccttttgtttttctccctcaatcctggacattttgtttgtttttctttatttcactaattttacaataaactgccaggatatgtctccatgtctagctctttttgtgaattattctggaaataacagcctctgcaaggctgctaaagtgacaaaggtatttttcaatcgcgtctgattcctttcagatatttccatcttcctactccatcatccatctctttttaaaaattttgttttgtttttgagacaaggccttgctctgtcacccagattggagtgcagtagcatgatcgtagctcgctgcagccttggtcccgggcttaggtgatcctcccacctcagcgcccccaagtagctgggactgcaggtgcacaccccacgaccagctaatttttgtgttgttagtagatactgggttttaccatgttgcccaggctggtctcgaactccggggctcaagtgatccgcctgcctcagccttcatgttttctttaccagttggttccctctctttcccacacttgctaagaccactactggttcactgtcacgatgtcacttacttttttgactaccttcagtgatctttcttttctgatttatgtatatatttcctgagtaatgtcattctttattaaaaatgtatatgtatatatgtgtacacaaaagtatacatatatgtgtatatatcctaaatgattctattatttattgaaataaataatgtatgtataattatatatttatatataatgtaagcattagtatataatgtatattatggatacattatatatacattttatacacaattaggttctgtgtatactatatatgtatgtatacagacatgtgtatatatatatgtgtttataatatatacaaatgattgtaacagtgtgtgtatatatgtgtttatgtgtatatatagtatatatataacattaatgtgataaaagtgtatgtgcatatatgtgtatttgtgtttttgtacatactcatgaccacatttaaagaataccattgtaaaagctgaccatataatcgtctatgcgcatatatatatgcagcaaaaatgccatcatcttcattaataaatgccttctttattaataaatatacattggttcacaatatcaacctcagcattatatacatttcaacaaacatgctcattgttttaagcatacattattaattcatatttattttgttttaagttgagattgttataactccctcttttttcaaatttttagctaatggtactttttaaaaagaatgactttattgtattcaaattatcactagtgggataaataatgtaatgatgggaaaaagcttcctttgttccagctataattatctgtagttgtttatttgttttattcaacttaacattcatgttttattcaaatcatcaatatataatgattttgttctgttaccaaagatcttattgggaattctaaagtaataaattattttgaagaggtatcgatactattacactcttgatttatacctggatcaatgaatgtttttaaatatgtaagcgttcttttatgtttcttgttattttatatattttatgtaacatgtgctgtacacttcttagagttattgctagaacatttatcatgaatgtgcaaagaattttttcaaatatatttatgtgcatatatatgacaaatcattttgtgttaattttatacaattctaaataataagtgactcattctaaattatttagctgattctctagattctctttctcttgttggatagtcatatgcaggagtgactttattttgtctccttctttctgatattttcagttctcaatactttttaataaaaacatataggcttcgagtctgtagaagtatcttgaaatatgatggtgatgatgaacatcattgccctgtttatacttttagtgaaaattcacttagtgcaacatttcttttcctatttgttgataagattaaaaaggatttcctgccaaaataaatattccatgtactctactttttaaattaaatacattaatagtaccagatactatttgccatctttcaaatagcttttttctcctttgatctttccctcagctatcacctgacttctttccttcaactgtgaatgagacaaagcaaaacaccctacttcttcccattgaaccatcttactgtatttgtagagtcaacctaattccttattaggtcactgcatagtttttttttaatttaatattttacgctatttattataatgatcattggaggaataatcagaacgtgttaagattctttacaagtaacttttacattttagtgttcttggcctttgaactgcgttttggatgaagaacttttaggattttctgtgcttgggggtgctaaaggtgtttacacctgagtgaatgcccagaatttgatcatatagatttttctattgacagtctcaccttcttatggttattctcttgtaaattatctttacctcaagaccaagatttgcaaatatattgattttcagtagatgcagtgttcacatagtatctcctgaaacaatcactttttgcagtgtcttttgtatatcactggttgcgtccctttactcagatctaaggtacatctgtttctgtatttttccttatgagtggtctggattttaattctttcaatacactttatattttattggagtatgctttgccaacgcatcctttttatctcagactgttcttatgtctctgtaataaagaaactgcatcttattttactccatgaaaaatcacaaatgattccctaagtgttcctttagagtgttcctgagaggactgtggttgtcttttattctacattgtgtgtcttttttaagactttattagcgcagttttaggttcacaacaaaatagaggggaacgtacagagagttctcatatatcccctgcccccatacatggacggtcttccctattttccacatcacccaccagaggggtgtgtttgttacaatccatgaacttacactgacatcttcatcacccaaagtccgtcctttacagtaggctacagtcttggtggtggtgtacattctgtgggttcagacaaatccgtaataacataaatccaccattacagtatcacacagtatagttctgcaaccctaaaaatcttccataaaaaaacctccacaattttagcagtttgtaacaacaaaggcttatttcctttttctgaagttcatgtcggttgtgggtggacttgcttgttacttaggtagactgatattagaaggtgggaaaagaataatacctctccaggaaaggataggaactattttgaaccaataatacagctcactacacaaaatgagtgaacacagtcacactgaaagagagatgagtgacatatgcttaagttatgcttatgttgacaaggtctcactcacctaaactggagtgcagtgccacaattatagctcactgcagcctgcaatccctggactcaagcagtcctcccacctcagcctcctgagcagctgggactacaggcacacacctgtgtgattttgttatttatttatttatttatttatttatttttaatagaaacaggttctcattatgttcctagactggtctcaaacttcagcgttcaagcagtcctcttgccttggcctctcagagtgctggaattacaggcatgagccactgcgcccagcctcctttagtgtttaactgaacagaataaagaacctcttcattatggtgaattggctaagttcaaaagagtagcaaaagccttcgtgggcagtaataattactctatcttccaaatacttgagtgaccttatgcttcttaaaatatatattttagggctcttaattgaaatcaattgcctttatagcctctattacagcatactcagaaattgaagagcgggatgattttgtataaatctagactaattttgtttttctggaatgactagaaccatttaccatgtcaggtacacacacaagaaacgctaagggcgagttgtgaatgatttgactaggaacaatagttgggctgcttttagatgtctccttttgctacatagacagcaaaaggagaattcaccaaaggtgccagcccttcagaatccttgtcccacaccaccaaaaagtcctgtgacagaaattccacctattaatcagctgctgtgtcctgactacggagaaaagtatgatgcaacagaacgcaaacttttccacaatctcataacaaggaaaaaatatatgtatgtataatatgtgtacatatataagaaaatgtatattacatatatagtaaatacatacaaatacacgtatgtgtgtatgtatatatacacacatattttgttttgttaggtattttttatgactatttatttaaaaaagtcacattgaaaataaaattgacttttatttgccctaagttacctcttgaaatattgtgttaaaaacctaataacttctgacaggtatatatatacctgtagaggttaatatatatacgtgtgtttgtgtgtgtgtgtgtgtgtgtgtgtatgcgcgtgcatagaagttattaggttttgtttgtttgatggttttgttgttgttttttgagatggaatctcactctgtcgtgcaggctagagtgcagtggcgtgatcttggctcactgcagcctccgcctcctggattctagtgattcttgtgcctcagtctcccaagtagctgtgattacaggcatgtgacaccatgtctggctattttttgtatttttagtaaagatgggatttcaccatgttggccagacttgtcttgaactcctggcctcaggtgatctgcctgccctggcctcccaaagtgccaggattacaggcgtgagccactgcgccaggcattattaggtttctagtacaacatttcaagagttatatgtatagatatgtgtacgtgtgtgtgtatatatatatatatatatatatatatatatatatatatatatataaaacctctatgggtatgttaggtttttaatacaacatttcaacaagcatcttaggacaaatgaaagtcaattatgttctcaacatgacttttcttaataaacatacatttaaaaatacctagcaaaatacattatttagtacctatttttaaacacactgtggtttaatctcaagctcatagattcttcgagataatattgtctatcagctgaaaattctaaaaaaaaaatgggaaaggctcatgtaaatataataggatttgtatttcatttctgaggacagaaacatttcaatagtaaaatttgcaacaaaaagtgcttatggaaagttagacaatgctctaggactctaatagtaagcacaggaatatgtcagagacccataaaatctttagatttattttgattcctacctgtaaaagtgtgaaatcaattattgctaaatccagcaaaacagcaaaggaaaattactattcacctttttctctcagtctgtcttccaaagctactaagagaaaaacaagaaaaatacagaaaatcctacttccattattacaatgaagcatttttgagctagtagaaaattagaattagaccttgcttttactggcatcacaaaagcatttcatcctgttttttgaaatgacaaatggcagaattcttatatacaatatgctaaccaaaatcatgttattgccacgtcatgaattataatttaatttctactctcaaagttaaataagaagatacaatattgcatttccctgcttgaagaggagaattagttacacttgttacgtaaaggctgtattcatcactggttgtcatagctgttatgactgtgactcttataatagaggtgggcttgcagccaaaaatatatgattcatccaaaagatatttaccatgtaacttatattatatgtgctgaatattttggtagtcattgcaaattaaggaatatggtgttgaaaaatcacaggtaacacctttttcttgttgctaacaatctaacagggagaccttatttaacaagatatcatattacacattacaattcatcttgtgaagaaaaatgccaactacagtgaataattgaggaacccaagttcatttacgaatggaaggttgggatgaacagggaatgcctttctgaggaaatggaatttaagctgatcagtaaaaatgaatcttccaggagcatatgggctttgcagatgggagaaacagcagagaatgcccaaaagttctaaaggaaacctgatgatgaaatgagttaagccatgttcctggtagtgtatcagttagcttttgctacataaggaaccatctcaaagccgagcatctcaaaccacctttatttagctaagcatctcaaacaacctctatttaggttatgattcttggctggacatctgggctgtgctcagctgggaggctcttcagtctagagtcagcttccaggtctgttgggtgctcattggccaagcactatcttaacagggtgcttgacagtgctccatgtggaatatcatcctctaacaggctagtatagactcttcatggaagcttgtcagggttgcatgtaggtgtgttcaagtcctcttataatgaaagctaagaataaggacagtgtgtcaccccccacatccggaatgtccaaataagcaaatccagaaagacacagatgaatgggtagtttccaggggctgagagtgaccactaaatggtaccatatttttttgggggggatcatgaaaatgttctgccattagatattgtcaattattgcacagatccatgaatatattaaaaaccattggattgcatactttgacacggtgatgtgtatggtatattaattatatctcaattaagcaattatatctgtctatcatttatctgtaaaccagataaaataagacaggctaggtatatagaaaaatagaacagaacaaggtaggcagaaacagaatctagcagatataaaacttggcatgtaagtaaagagctgtaatacctatgtagctgaaaatggaactgttctctaaggaaataattaaaataatctctatgctctagcatccagataaataaattccaggtgagttatgacccagatgtgaaataaaaccttaaaactgttaggagaatatgtaagcaaataaaatgtctttatgtttctggattaagtaatcctttttttttaaaaaaagcagaaattatagagaaaatagtgataaattataatacttatgcattttaaagcattagtttagataattaaaaatcaataaaatggttaaagacaacagactagatatcaccaatgctcaactgtgtaaacttgggcaaattatttaatatctgtatacctaattttcctcagctataaaatgatattagttacacatctcataaggtatttatgaagattgcatattcggagctggacacagtggctcacacctgtaatacagcactttgggaggctgaggtgggagacttgcttgaggccaagagttcaagactagcctgcacaacatagtgagactttatctctacaagaaatagaacaaaattaaccaggtgtggtggtgcacacctgtagtcccagctactcgggaggctgaggtcgaagaatcactggagcccttgagttggaggctgcggtaagctacagttgtgtgactgcactccagcctgtgtgacagagcaagactttgtctctaaaaaacaaacaaacaaaatgcatattcaacatgcataaagcccttagaaccatacgcagcactgctatgcactgttaaatgtttgcttttacatgctcaaaaagaggccagcatccatgaatataaagatttcctacaaatcaataacagacattcagccagtcaaaaattggattgctattcaagatgggaatttagaatgggaatatagaaatgcatctgtactagttttaaggaacatgcaaattgaaatataaactgttaatattttatactcatcaaagtggcaaatgtattgtctgataatgtcaagtgttggcaacagggtaagggccaggaaattttcttacctgctagtgggtgtatagcataatacaacttgtttggaaagaaatatgccagtatctactgaagataaaattagtattaccctatgtatcagttagctactgctgcataacaaaggactctaaaagtcaatgccttaagacaataagcgcctattactgcttatgagcctctgcatcttgttagctggaaatttattttggtcttggctgggctcattcatgtgtatgcattgttgatttggagtgagttctcttaggtaattgggggttgctggaggtaattttgcctaggttagggccaatgggttcttctctatgagatcttttgttgtgcaacctgctagtctgatttttcacaggacagtggcagaatttcaagagagtaagaataggtacaggggatttgagtcccagtcttggaaacagcacatcattatattttttcttttgaaaaaatgcaatcttaaagccactcaagattcaaggggtgaaagtacagactctctatgtatgaggaatagtaaattcatggggaggattgtagaactgggaaccttttgcctgtcagtggactacaccctgtaattcaacaattgtctatctagtagttatgtgccctggaactggggtcttcaaactggcagatgtcttttcaaaatttttcaaagtatgactctgctgatgattttaaagaaactaattttcaggtactcagcccccagatgttctcctttctaagccttcctggtcaccaaaagcttcttcccacatcacaaaaggatgaccttcagtaggcatgacactttgttaccaaccttttctgccagggtttataatacaagaaatatctttttgaatgctgctttctggaaagcccctttgctgaaggctccataaaataagcctcctatcttatacatatttccattaagagtgaagtttggtcctgttcaggtgttctgatttcagaaaaagaaaaaagaagccataggtcagctatggcagttctttcaaatgcagaaactgaacttttctgttgctaaccaatttttcaaggtgcatatacattgggtgaagcccatcggtaaatgatccaatccgaaaatcatctgaaggtcatctttcaaattcattgtggtagtgttattcaagtggaggctcaaatatatttcaagtgtatgcatggaatattttccccagctagagtctgttctccaggtgtatggaggaaagaggagttgtccaggttgtgtacctgttcttctcatctttctggggctattcatgtcctttctgtgccctcagcctccaacccatgcttctgctcagagcagcctgttttctttgctcccataaatgtattcctggccccagatcttctgtgcatatttagaagccctaacccacttcctcaccagccacccctctatccccagactctcctaccaggaacagcagaggatcctaaattcatgcatgcattttcctgccccgttggaatgatctgtgtgcatgtctgtctctgatgttcatctccttcttcagtgtgggtgtgtcattacctcttttagccaggactgcatggcattacctgtcttagtcgggactgcatgttaaaagggtcaacacatatttgtagaaggaattggcttctgagtgaatgaacccatgtgtcatgggcagtctgtgaggacataccagtcacttccttgctgccgagagctggggatattgcattggattagaagattaagcccatattactctatggccaagtgacaaaataatcaatcacatccacatctgtgatagccaggaaaacatttctttccgtgcccctcccccaccccccgccgtatgcaactttccctgtgtggaaataatgtacttagcttaaaaagtctctttctctacttaacaagactaagttgaaaattaaccttgcccacttaaaagaaaacgaatatgcagtaaactatgaactactaatacagttcaatatgatatctcatgcagaacaataatgctgaaggttctttttggttctattatttccttatattcttgcttagataagatcacatttgtatctattgactttctatgatgatttagatacataagtggcaataattaatatatattaaaaatacagatttaaattgtttttctgacttgtaatgttaacagcagtatatgtgactgtgaggttttcctttgatgttaattttcactttgacaatagtcttcgttttccaattttttttaatttttttatttttatttttatttttttttgtgataaggtctggctgtttcacccaggctggagtgcagcagggcgatctcagctcactgcaacctccacctcccaggctcaagtgatcctgccacctcagtctcccgaatagctgggactacaggcatgcaccaccatgtctggctaattttttgtaattttcatacagaagaggtttcaccatgttggtcagtctgttccagaactcctgacctccgcccacctcgacgtcccaaagtgttgggattacaggcatgagccaccgcgcccatatcattttccaaattctttacaaagtttttctcttacattcataacataaagtgctattttaaatagactaacttttgaaaataacatagataaagcactaaatggggacatcagaggaacaggctaaaaaaaagctggaatattcttcaggattagggacattgagattttatttataaaatgatatttaaattttaataatagaattgttgtacttttgcttggagtatttaaatcttctctttaatatttaaagccagttctgcacagaggttttacggagatgctaattgttgtatgaaaaggaatattattctggaattttgaggaagggtagacatagagaagataaaggaaactcacagcctacctaggttttatttgggctgtgtgtgtgtgtgtgtgtgtgtgtgtgtgtgtgcgccagccacaagctgggtttattcttgaataaactgtagacaaattgtttttcctgaatcttctaaaacctgcatttacatagtccatggttgtgtctaaactagatactcaagagaacttggtttgttttaaaggcatttaattagttatatttacatggacaaatagagcagcagtttattaaaaaagaatgaaaggataaacaaattaaatatacgtagaacaggaaagacagcatctaattatgtttctgggtcaggctctgatatacaagattaatttaaaattgggatttggcaagtaatttctatcgaaatctcagcaggagtttttattgcaactaacaagctgatttggaaagtttcatggaaaggcaaaggatctagagcaatcaaaaagaccttggaaaaggggaagaaagttggagggcttccatttctctattttaaaaggtactataaagatatagtaatcaagatagcaggcaactcacatgggtataaatttagaccaatgaaatataattaattacagttggcccttgaacaacgtgaaggttagaacccctgcacagtcgaaaattcacttaaaactttttacccccccaacacttaacaaccaatagtctactgttgactggaagccttaccaataacataaacagctaattatcacatcttttgtatgttatatatacaatgcactgtattctcacaataaactaagttagagaaaagaaaataccattaagaaaatcataaggaagagaacatatatttaccactcattaaatagaagtggatcttcttaaagatcttcatcctcatcttcaggttgaataggctgaggaggacgagggagaggagaggttggtcttgcagtctcaggggtggcagaggcagaagaaaatccacatataagtggatctgcacagttcagaactgtgttgttcaagcgtcaattataagggtttagaaataaatccttcaatttgtagtcaatagatttttaacaatggtgccaaaacaattaaaggaggcaaggatagtcttttcaataaatggtgctgagacaattggatattcatatgtaaaaagatcaatttcaactcttacctcttattgtacccaaaaattaactcgaacgacaggtggcaatataagaattaaagctcttaaacttttaggaaacttcagcaacacaggagaaggtcttcagggccatggattgggaaagatttcataaatatgacctcaaaagtacaatccttaaaagaattgatcaagtgaaactcatcaaaattaaaaacttttacacttcaaaaggcactattgagaacataaagtgctatttgttgagaaaaccaaaagacaagccataaactgggagaggagatttgccaaccatattcccaataaaagacttttatttagaaaatatgtaaacaaaccacttactattcaataataagaaggaaagaaattattttttaatgggcaaaaataaattaatagacatttctgcaaagacagtgtacatgagaagatatttaatatcattagttactaaacattagctaaatgcaaatgaaaactacaatgaggccaggtgcagtggctcatgcttgtaatcccagcactttaggaggccaagatgagtggatcgcttgaggcaggagttcaagaccaacctggccaacagggcaagacccatgtctactaaaaatacaaaaattaaacaggaatagtggtgcatgcctgtagtcccagccacttgagaggctgaggcacgagaattgcttaaacccaggaggtggaggttgtcgtgagccgagatcgtaccactgcactctagcctgggcaacagagcaagactttgaaaaaaaaaaaaaaaaaacctatgatgagacaccatttcacatccattagtatggttataacaaaaaaggatattagcaagtgttggctaggtattagagaaatagagaccctttataccaccgttggtgagaatgccaggtattgcagctgatttggaaaatagtctgtcagtttattaaaacattaagcataaatttgccttatgaaacagcaatttcacccctaggtatctatgcaatagagatgaaaacatatatccatgcaaaaaatagtacacaaatgttcatagcagctttattaataataatcaacaagtagaaataaaccaaatgtcactcaacaaataaatggatttaaaagatgtggtatacccatacaatggaaaataatttagccataaaaaggaatgaagtattgatgcatgctacagtatgaaaggacattgaaaacatatgctaagtaaaagaaaccagacacaaaataccgcatattatatgagttcatttatatgaaatgcctagagaaggcaaatcttataaagacagaaagtggatcagcaaggctatcacacccacgcaccacccaggtctggttttaaaaggtattaagcccccatgaaatggacattacttgacttttgtttgatatatggaaacagcattatcaagtcttggtttcaaaatatgtttaagctcttctgagttatgtagaacagaggagtgttttccattcacaagtgttggagatgacagtattttccctttgccttaatccgcttatcctagaaccctataggaaggcaaagactgtcttgattgattgacgcagttaaagttattgatagtgggatatgcacatatgggctgcatctgtctatgagaaggaagcaatggagccaattaattaattcaagcaaaattaaatgttcacaccttttaaatgtggaaactataaaaaccaaaatggtgctctgtgcactaagagcataagctagttttttgctatccttaagggcctcttcctgcattttgcctatattaaaattcctatgcagatcttattgaggtgatcaaggtagatgacttcgatttttattttcttcaacaaattcacgtaccaataactttcaaatgatatttagtaactattttaaacacagaggacatgatcttcaaacgatatttaatagctattttacacacagagggcataactttcaaatgatatttaataactattttaaacacataggacatggtctataatgttttgtcctgacttaaatatttattgcatgtagtagattttaatagaagaaaacaagagtgaatagtgggtagtgcttctctaaacacagagtagaggtaaatcttagtgatttaaattagtcacaattctgactttttgagattgcatgtttataagtttttaatgcatgaaattaatgtcaattatataatattttgaataaagtccttccatgtttactgtgtttttgcttgccttatgaaaatttctaaccataatgtgtcagtaacatttcaaaaatttatttaaattacaacatgttaacatcagaggaccattgaatacgccataagcatttctttaaagaatgtgggaaatgtcttttctaataatttaattttttctttttttaaaacaactcacgttagcatttttttttttgcagtagcatcattttaacccccaactgcatattcacaggatatctaatattttttgcaagtaacattttgaatttgttcttcttgacatctttatgtttatatgcattttgcatttccctatctcatttttttgaaatccaaatgtaacaaatttcaactttttgtgttacattcttttctttttttctttttctgggtagcatctctctcttttctgaattttttgaaaacctgttgtttttgaattctcttttttccctttattttccttctcaatatgaccccaggagccaacacaaagaaaaacgcagatgatataacgagtaatgaccgtggtgaagacgaaggtattttttgttttttcaaagctcaaccccagtgcatgattttatatctatctatctctctttttttttttcatttcaatctgttttttctccccttatttaaaactagtacactttggtgtgcttccttaattattttcttcttgtatagaaaccactgtcattttttaatcccagttaccatgtacaggaaacaaatcactgtgagaagtataaacattgtttctaaacatgaaaagagtaatgaactactgtttacagagaagcccttttttttttttttttggcttggtcgcaagaagagaaaatggaattttaaaacatgcatgtatagtctattttctcccttccaaatgttattttgtaagttaatatactactttggagctttggtcttcttaattatttttatgaactacaaaactgtacagcaccttagaagaattttttttgggggggggggggctgaaatatcagttttttttttcttcacaaacatattgattccaacatagatttctgataatctgctcacagtgaagtacaccaaaaagtgttttaatgagatgctgttgttaacgagccctgatgcattcaggactgccttttacagcatttaagggggggtggggaagataagagtatctcagaactgaaaaaggacaaaaagctagctatgttcatctttcttttcacaccacggcttttttgaaaacgtttttctccttaaaatgttttgttgctgtgaagtttcttcttaaggctaccaaattgctcaacacattgtctaccagaagtgaaaggatttttttttaaaagatggtaggtctgaggtactcatgcagacaactcgcatgctgtttttctgccctttctgcacaagaaatgattttttttttttttaaagaggagaagcaacaaaaaaagtactcaagcaagcccttcttcattggtaaggctctataggattagctaaaagcacatttttcccatctgggtagcaaaatgcatggaactccattaaggtcctggctggacctttgggtctctgtctgaaaggcaatttaaagcccaaaagtgagtcctgaattatccttgctggtcaagcccaacgtccatgacagggtcttttgaccaattcttgtagttgctcccctccttgcttatcttcataaatcaactgttctccaagaaaagaaatcttgccaacacccttgctgtgcccagtcttcccttaacattttgagtattgttacttttactgagctcatagagctgtcactgtctcaagtagctctctgagagatctccattctgatggccataggagatcaaaatctacacctgcttcaggtagccccttctttgataagggcttctgaatgcctgacattttatcagtattgagcaaatacataaaaatgaaataaacttttgtctcatatcttatactgctctaatttgtatcctgtttggccttctctttttaatacatttcctctcgataattagaatctgttttcacagtgttcccagtgaatctttattaccattaaaatgccatctaattttcatttcatattgttaagttatgattttttgactttgcattaatataacagctggttattacttccacaagttcaagagagtcttgttctatattttatgaaaggtaagagatgttaatctcacatattttccaagggagcactttaaagcagcccttcaaaatctctacttactcttttttccacaatttactaggcaaccgctggtaatggtaaaagaaatgaggccaaaaacagcaaattaggaaccagaaagaagcagtggatcatgagaaaagccatttcttattcatatagcagaagacatttcccgtagtgtatgatgaataaatgattaatagaagatttttacttcatatttgaattttatatgagaaaacaaaagacacttttctgccgtggattaaatatctgcaaataaatacttgggtaacttgacactcttttgtgtgctttactgtgaccaatgggtatgtcgtgtcttctgtatgcacccagtaaaattgtgatcataattcattcaaattggagccaccatccaaacgatggtaattcatatcctcagaattcctttgtggtatttcaaaagtgtccctgtggattatgaggaaaaaaaaactttattgatgaagaaattgaaaataaatatgcataaatacttgagttttcttttagttacaaagatatttaaattgtacacacacacacacacacacacacacacatatctgtatccagaaatatttatacgtgaggtcagtcttccaaagattaaatgcagccctaatggctgattaatgttataaaacaggtctttttcacaaagcaggccctacagatggtctccaactttctatcatcacagatcattgtttttacatcattgttaatttaaataataaagtaaattaccaagaggaatcattggttgcaagtcacaatgggagtttatattccctgtgaaaatataaagcatttaaatagtttggattcttttgccattttttattacatctcttttatttttgtcacctaagtatgttagtatgttactgtaatcactggaacaaagacatttgcttggacatcttttcttttttttccctatttctgttcagttaataatttttaactgttgattttgctttcttgtcattatctgtcccttattgatagtttatagcttcactactacttttatgtttttattgttaaattgaagatgaatctgtacactcacctgcgaattaagatgcaactatattaaaattaattataattttgaagttgattttatacttaattagaagataaaatatatttcatcaagggtcccatgtgtttattcaatttaaatcacattttagggtttgagcaaaatttaggaaatgtgtactttacctaaaaccatttcttttagtgctttagatatatatagaagcttagatgagcagagtacgctaaatgtctgtatgcttcttaaaataccatttccataaatagaaaacgtaatagcattgatcattttccttagacactcttatcaagggtcatatcatccataaaaataaatgtgcttaattcaagtcaaaatagggaaatcagtgaatctccttttttcttaatttagcattggtgagtcagtgtgattctttattgtgtttccttacttggcttttttttccagatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactaggtaagtgatttcatcatgtgaatgactgagcaagaggaaacatgaaaagtccacttctcgttttgacggggctcgtggatttgaatcctgttattccagttcctggttaattccacttcacggtatttactttatgtgattggatatgtttattccttttactacctttgtgcaacatggtcatgaatcccttctcaaaccaatgcagactttaagatcttaaagatgaaatgaaattttatttatagcatgtttctcccttggagttcaatgaatgtatgtttgtctacatagacctgtacaatgaacacatatttggtgatattatagttgggaatggccatagatcttagctttcttttctgattgtgtcattgtatgaatcagtatattgtgtggaggaaaagattttatccaattctctaactgattatgttgagcctttggaagatctgttgttttggttccattgcatttgcatgcagggaaacttagctgttagttgacttttgtccattgatgatctacgattaaaggctaaatacatggaaattcaagtttagttcctccttgttttgatgtttcatttcttttctttctttcttttttttttttttctttgagatggaatctcactctgtcgcccaggctggagtgcagtggtgcgatcttggctcactacaacctctgcctcccgggttcaagtgattcttctgcctcagcctcccaagtagctgggactacaggcgcatgccaccacactcagctaatttttgtgtttttaatagagacagggtttcaccatattgaccaggctggtctcgaactcctgacctcgtgatccgcctgcctcggccttccaaagtgctgggattacaggtgtgagccactacgcccggccatcattcatcttcttctaattgtaggttggaaaattatacatcttcagagtcagatttcagtaccttctgagatggcctttcctggtgttggttagtttgtgaataatattcctaagacctatgtaaaaacatttgttttccaggcaaaaatgcattaaaatggtatagaagataaagtttttaacaagttagccatgagagagatgtgtatattggttccagtgtgattatgatacaatatgaaatacaaaacaaaatgaaggccaggtgtggtggctctcgcctataatcccagcactttgggaggcccaggcaggcagatcacttgaggtcaggaattagaaaacagcctgaccaaagtggtgaaaccctgtctctactaaaaatacaaaaattaactgggcctgatggcaggcgcctgtaatcccagctactcaggaggctgaggcgggagaatctctggaacccagtaggtcgaggttgcaatgagcagagatagcgccattgcactccagcctgggtgaccgagtgagacttttctcaaaaaaaaaaaaataataataatactagtaataaattaattaaaataaaaagcaaaataagatggactaaaggaggtctgtcaaacaagaaatatgactgaaaatgttttcttcaaatatggccaagaatattttcttttcaatcagatgacttcatttcattttgagtgggtttttttttttcctatgtgaaaacattaacctgtaagaagccctaaaaggtggtgaattgctgagaaaccctaagaggtgttgtaagaaaccctaagagaaatgcatttcttactttgaaatgcaaatcagtcacaggtgttgctaaagttgtatcttttgaaacattgataaagaactcaaaattccaggttggtttctgcattaaagaaaataaacaccaccaaaaaaccttttagtgtcaaaaaacttattatgtcgttggctttatttcctatattttttgtagttttctgtgagccacatcttggcggaataatgtctctgaacttttgcatagcagtaattgcacgcttcactgaatagttttcagaggcgctggatagttgctttggctactagtgttggaaacaggaaattgtgcttcttgatgttttacaaaaggttcattctgacaaagaggtggaaggaggaaagtatgtgtgagggcattgcacaggccctcttcaaagggagcagtgtgtgcactgcctgtagcacggccacacggaagaaagcttgggcatgcttttctgagggaagcagtgggcatcaagaaaattcttgctttgctggaaccacacaatattctgttgcatgcgtgatgaattgatgtgtctgataagatagagtttcaaaataaattgatctccttttccccctaaagctcagttgtatcaagcaactctacactatgattttttttttatcagttttgtcccttcgtgaatcaattgcacatcttgcaaattagcctggaaagtatacacactttttttagaggaaaaaaaaactaattgaaaaattgttaagtctactttttgttatggagagtttttaaaagtcataagataacagagagctgtaaaattggtggggaagaaataaaagaagcgatttagcatctctatgccggtctatttacattcctccaatgagctagtgtggaacagccaagcacactacagaccccctttcatttgatggaatgaaatgtgccaagtttgccgattttacaggacgatagagactttaaaatgtgactgcgttggtttttatcatggatcttgcatttactattgtcctcttgaaaacagctaggcggcatttactttttgcttgcaggaaactcctattatcggtcttgaaaaaatgtttttaaacctttggcatccagatatttaaaaagatgatcaaataaaatacacagcaggcactgcaatgatcatttcagtgagtgcatttcatacaagtagatacaattttaggcaaaaagttgaaatattctttgagttctttttcttccagtaaaagtcataaatgcataaatgttatcttcctacctgaggaatggaaaaatattgttttaagattttttttttttaatggagtaacaaatgctattctctgttacccaaaagagaggattaaaaagatgaaacatgcccataatggaagcggaatgctggcattggaaagaatgtagatcgcagccagagacagacaggagctaacaactttcctctacctctgccttgagaaagtcagctagcgtttcctcagactctttccttagatgtagaaggcagtggtctctcccttgcaaggttgttgtacagtataaaagttccatggttcaaaataccacactttacctcattaatatataatctgcttgtcaataaaaaaataacttttttcttttctttttttttttttttgagatggagtctcgcttttattgcccaggctggagggcagtggcatgatctcggctcactgcaacctctgcctcccgggtccaagcgcttctcctgcctcagcctccgcagtagctgggattacaggcgcctgccaccacgccccgctaatttttgtatttttagtagagacggggttttgccattttggccaggctggtctcaaactcctgacctcaggagatccacctgccttggcctcccaaagtgctgggattatcagcatgagctactgtgcctggccaaaaaataaccttttaaaaaagatttaatggactcatgtagatgaagtttcataggctctcagcagcaaccattatacccagtcacactacaatttctagtgttattaataccattatgcattgtattaatactactgtttatccacagtaagaattgtagctgacccaacctgtaatggctaactaatatctatcaaatattggcatccagactgaaccatgttaatttaaaataacattacaagacacttgtagacattaaataaatcagaagatcatcatgtttgctattttttaaaaaataatcagaactgtgctacacaatcttgctagccattggccatataatttatgatccaatccaggacatgtttgagagttgctcatgtgctatgaataaactgggattgtcccaggcaaattgagatgtatcattatagctataaagtaattatttatatctacatgaagtgtcttctgattgaattggtgttcagtttgtttttaaagaagctgcacttctataaacagatttcctatgtgttctgctatacacccttgtcactaggaaggtgtatatgttaccagaaagggatcctaatccagaccctaagagagggttcttgattctcgtgcaagaaggaattggaggcaaatccgtaaagtgaaagtaagtttattaggaaagtaaaggaataaagaatgactgctccataagcagagcagcccgagggctgctagttggctatttttatgattatttcttgattatatgctaagcaaggggttggttattcatgagatttccgggaaaggggtggcaattattggaactaagggttcctcccctttttagaccatatagggtaacttcctgacattgtcatggcatttgtaagctgtcatggtgcttgtggaagggtcttttagcatgctaatgcattgtaattagtgtataattagcgtataatgagtagtgaggatgaccagacatcactctagttgccatcttggttttggtgggtttcggctgtttttttttactgcatccttttatcagcaaggtctttgtggcctgtatcttgtgctgacctcctgtctcatcctgtggctaagaatgcctaacttcttgggaatgcagcccagtaggtcccagccttacgttacccagcccttattcaagatggaggtgctctggttcaaacgtctctgacatatatattcaagaatttggaaaacctcaagttcaccaatgcctctcagattagtcattgccagggtgtgtggtgttcctatctgctcagaagccagaagccagcaaaatccttgctgagctgtacgtgccagggcatttgcctggtctcacctacccacttgagtacctatgccctatcacccattcacctcacaacatccatacgtatcatttacccctaagaagattagacattaatccaggtaataaactttcagaacaatcacctccagacagaaactgcagaggataatctgataaatctgaatccctgtaaggccattactgaatcaataaatactcttttctccatcttagttccttactttagtataacttgagttctccccaatctgttttttttttgttgttgttgttcatgatagtccaaagaccttcgatgtaaaagagaatgcatcttgctcatgctttttgatggaaatacctggaacttatttattccttcccctttccagttgtctccaagtgcaagtctgtctgtacctgcagtggatttcatctacctccatttaaatatgtatttccgtttagctcacatggtactatcacctttttggtgatcctatgacttcatgcttcatgtatgctgaaattaattgttgcttcaaaagagtcccaactatgtaacatcaactcattgtgtgcctctatgtggctggcagatattacttcatttaatcttcgtaaactcccttggaagagttaaccttatgtcctacctatgaggagatgaatgctttgaggtaatgggatttactcatggcatcacaccttctagcagtcagagcagggactgaaacccgggtgtaactgaagccagagctctgacttaccactcagaactcatccacagccttcttaattaatgtcaagtatgaattagtaaaccatggaatgagtgaagaaattgagtatcactttagcatcagatgtagcttttatcattatgcaaaaaagttcttactgctgatcaagatacacaattgtgataagatgcttacagtgtatttttaagttcctcaaagtgggtccttgaaggctgattcatttccattcaatcgatactggtttgctttggttcacggtgatggtggcattaaccacaacaatggcatttgtcacatcaaagctcttcggtgcagtagaactagtgtttcatcaggaaatttggtgtcctacccccagttcccatgtcattgctggcttgctgtgtcgtgtgcataaattgagtcaaatgatcatttcggtgcatttcttacaatctttcacatattatagctatcctgaaaattttcatctgagggtagattgcgtcatggtcttctgaagttgtctttctctttaagaccattcattgaataaacctattagacgctttggagtcataattgaatataagacagaaatggtttgatataaaagcaaccaacatgcatagcagaaacagcatttgtagtcataatttgggtgacttaacccatatgcacgtgctcagcctaataatgtggtcactttccctgttctggtgtcccttgtagggttttcctctgaaattgagggagggtgggctgagctctgaagcattcttgcaacatcggccagagtggtctcacctttatgcttttgtgatatgtgtgagccatgtaatattccactcaacaaaagaagcctggaaatcattagaagagaggaccaatacgttcttcccaagagttacagcctcaattccatgggtgtgcatttatgtgacatgcatctgacattagtgggagttcaatgggtcactataatttccctgaagcacacctgctgaaaaatgtcaagctatcttataaatgacctgtatgttcttctcccctttggaagttagaggagttgctctatttttggtacatttgctattttatttctttttttctaacaatatttcttttctttaatgctttatgaaggattttatttgaaatgataaatggaacacatcttatgtatcaagtcaaaagttcataagcgtatatattaaaaaagaaagcatcatttcctttttcgagaatcaacacaccttgatgccagtctcctggtttcattagaatccctctcttctcttcctctaaccaaaatgtctcagattcccccgatttgatttctgtaaatggcctactttgactggaagaattgcctctctctgtctaaaacaggacccaggcgttactaaaacaaaacactgcaaaaagttaaatgaggagaaaggaaagttaagcattgtacttagtgagaaatacataaacaaaagtagagacgtaaaagaagcatgagagaagggtgagaaagtgaaatcctgagacaagatgaatggtgtgtgagcactcaaacccaggaagtagcaaaaggtggaaggaagaatgggagcctttagaataagattctttgtgggctgggtggcagatgttatcggtaaagccagcctggggagttggcaggggtccatgcagtagataacacagcaatagagtgaacacattgcagaagatagggcaacctctaatccagaaattatcagataaagaaaaaccaagacactttgcaaaacaaaaaaaaaaacaaacaaaaaaacacaacacaatgtcttgtttttcatcatcatcttctttataatgaggtttccatgcattgaatacacacttggaaacactgtaatcccatggttgttgtggctgcagattgataggtgtggacaggtctttggtggggcaaacaaaaccaggatcatgttttttgctctcagaatgatcgtttgcttggactttcctcttctgcctcctagtggctcaaaatgcccactgcattcattggatttattcaggatgtgaagaaggtcaggggaaattaaggatgagtgctttgtcattaggacctgagaggcaaatggagcagagatggggacgactgcagtgggataaggactctctcaccaggaaggtgccattgatgtaatagttgatgggaacagcagagcaaagaggctccctcgtcctcagctgactcaacaacaagcgagacatcagatggaacggtatttattgggcaaggaaaatcaggggaaggctaggtgcagtggctctcacctgtaatcccagcactgtgggaggccaaggtgggaggattccttgaggccaggagttccagatcagcctggacaacctagtgagaccctgtctcagaaagaaagaaaggaaagaagagagggactctggatgaccaaaggacattatgttaagtgatacaagccagacacagaaagacgaatatcacatgttcttacttatatgtggaatctaaaaaaaagtcaagcttacagaagcagagagtagaatgttctcttacagaacttgaagctggaggtggagaggaaacgggagatgttggccaaaggttacaaagtttcagttggcaggaaaaagtcaaaagatctgttcaatatggcaaacaaagttgaatcacaaggaattgaatatctggacgtctctaagaaagtagattttaagcgtttgcaccagaaaaataagcatttgaaggtatgcacttgtgaatcagctcgagtaagcatttctcaatggagcatatttcaaacatcactttggacatgatcacggagctagttcatcattgctttgtcattaggacctgagaggcaaatgtgagcagagatgtgggacgactgcagtgaggataaggactctctcaccaggaaggtgccattgatgtaatagttgatgggaacagcagagcaaagaggctccctcgtcctcagctgactcaacaacaagcgagacatcagatggaacggtatttattgggcaaggaaaatcaggggaaggctaggtgcagtggctctcacctgtaatcccagcactgtgggaggccaaggtgggaggattccttgaggccaggagttccagatcagcctggacaacctagtgagaccctgtctcagaaagaaagaaagaaagagagagggagagggggagagagagagagagggagggagggagggagggagggagggagggagagagagagagagagagagagagagagagagagagagagagagaaaagaaggaaggaaaaagaaaaaattagccagatgtggtgatgtatgcctggtgtctcagctacttgaaaagctgaggcaggaggattgcttgagcctaggagttcgaggctgcagtgtgctgtgattgcactccagtctcagcaacagagtgaaatcctgtctcaaatttttaaaaaagactcaaaagaaaatcaagggagggagtggagacaaggtagaaaagaattttttttattttgtgcttttttccctaatgtattcatttaatcatcaaataaaaattgaatatattgatcatgtacaaagtgatgttttgaaatatgtatccattgagaaatggctaaatcgagctaattcacaagtgcattacttcaaatgcttatttttctggtgcaaacacttaaaatctactttcttagagatgttcaaatattcaattccttgtgattcaactttgtttgccatattgaacagatcttttgaactttttcctgccaactgaaactttgtaacctttggccaacatctcccgtttcctctccacctccagcttcaagttctgtaagagaacattctactctctgcttctgtaagcttgacttttttttagattccacatataagtaagaacatgtgatatttgtctttctgtgtctggcttgtatcacttaacataatgtcctctggttcatccatgtagtcccaaatgacacaacttctttccttttttttgaggtagaataatagtcccttgtgtgtataaaccccattttctttattcattcatctaatgatggacattcaggttgattccatatttcagctgttgtgattagtgctgcaatgaacatgggagtgcagatttctcttcaaagacttcttttttccaatcccaaatacacaaaattatcatctggcatctgtcatgctatggagactctccttgatctatttataaacgattcaggatttctttaaagaagctgaaattttatttttacatgcataaccatatttagaaatcaaaatattcaaacagaaatcacagaagaatctattccatcaatatataattcccagttaattgattatataatgtcatttaagcatgagttagtagtcacagagaatatgccttaaaaatgttctgtctttgaaagttttacattcaaaacagtctcttaagattattaattctaaaagacaccatccctttctctcttcagcctgttttcttcattttgcttctcatccagtatgtgaaaggttgatgatttttagttgatgaggttgacgtgccctctttctccttggggacagaaggacataagttgtgctttaaatgaaaataagagtatgatgagtatcccaagggatgatggaaagttccagggagaagcattgaaattgagagccaaattcaagtacattggaattagggttctggtgataattctgtcagtatctacatatattcaaggaaattagtcctttcgagtaggataatggaaaaatctctaaaaggcaatctgagcgggatgtttaaagactacgtgattattatgcagtgcatgcctgtaccaaaacatctcaagtaccccacaaatgtatacacttactatgtacccataaagtttaaaaaaatgtaagactactacacatattctggcctgcagctttttttcccctgacatttgcctacccgcctgtaatagcacaggcaattctacaagaagcatgaatatgcacatatgtacatgcatgacagcagtgatacaaagacagatgtgttgtgttctagtataattgtcttatttttgtccattccaacgttaataagtcattagctttatggaaatgaaccctaggggatgaaacatacaggtgcaaagtaaatttcctagggactaaattataaccaaattatggcaggtacaccctgcatttagcgatataaatatatgtttcaaataaaattgtaacatattgattggcacgtccagccatattcttaagatactttatccttggactaaaaataataataatcgcttttttgaatgaagtgtttaattttcagtgtaaaaagtcaggaatattttagaatgctcaacgcaacattgcttcaatgagctagggcctttatgaagataagtcactagaaagtctgtgttgattcggttaattatttgagattgtatgcactgattttcactgtgttaagtatagtggcatttattagaggctcagatgttatagagagaaggctgtgtccagttatagggctgtagtcataaacagatgggtaaaatcaacacatcattgtaaatcataaacaggcaggtatgataaacacataatgataagcatttcagcactgggtgcagtgttgcatgcctgtagtctcagctactcgcgaggctgacgatctttggagcttaggagttcaagagcagcctgggcaacatagtgagaacccatctttaaacattaaaaagaacaacaaaaaaacatcatttcagtgtagacaggcataacatgatctcacagagaaacactacgatttgtacacaagaaaactaagctttgcactggtgttgggagaacattttggaatgataaactatttcctgtttgttttaagaaatatttggtaaggtttaaagtagtgtctgcctctttactaaaatattccagtatctgtttagatgtcccagttggtcttagatacttggtggtaaacatatatatacacatatatagcgcatatatgtgtatatatgtgggtgtgggtgcatatgggtgtgtataatctatgtgtgtatacatacatatatgtgtacatacatacatatgtgtgtatacatatacatgtatcagttgtttgcccttgtgatgcacacacagatctatatgtgtgtatatatatgtgtctatatatgtatacatgctaatgtgtatgtatacatatataaaatatgttccttgattcacagtgggattatatcccaataaacccgttgtaaatgtaagatgtcattagttgaaaatgcatcaatacatctaacctaccaaacatcatagcttagcttggctgacattgaacatacttataacacttacattagcctacagttgggtgacatcatctaacacaaatcctattttataaataaagtgttgaatgtttcatgtacactgcagagtagcagttgtttgcccttgtgattgtgtggctgactgggagctacagaccgctgcctggcatccaaagagactatggtactgcatattgctagcttgggaatatatcaaaattcaaaatatgatttctactgactgaatatcatttttgtatcatcttaagatcaaaaatcataaatcaaaccattgtaagtccgggaatgtctgtgtaataatttggctatagtcttaaacaggtgggtagaataaacacattattataaatccatcctgtgcttttgaacacatggaggctaccccaccaaaatgcctgtgttcaatatattgcgaacctctaggtatctttttccttcattgctgtttaatttttccttctaagcatgaacttacaagattacttaggaatagcattcatccttcttcattcctctttgtttaaaacatgcttagcatttctcatcttgaaagaaatgagtagctttcttcttttcaatcatatttcatcagaactattctcttgagggccacagaaatgtcataagcattttctctggcacttctgatacttttaatggcttttgatacatcttcatgtttcttaatcttcttgtgatccttaccatgtaagtgacccgttgagcttatctccaactcctatttttcattgtctccttcctttatttgaaacaacttacatccagcgtgcacgtttgaagtgtgcaattcaatggcctttagtatatgcacaacattgtgacaccagcaacaccatctaatttttgaacattgacgtcattccaaagagaaatcccatacctcttctctcccaggtccccaggagataggcttccactaactatctacctgtctatatagatttgccttttgggggcatttcatgtaaattaaatcatataatacatgcttttttgtgtgtctgacttcattcccttaatgtttttgaggctcatccatgttgtagcatgcatctctactcttttattttttatggttcggtaatatttcattttatggatataccacactttgtttatccatccatctgttgctagacattgggatcatttccagtttctggctgttctcaataattgtgccatgaacgttcatgtgcaagtttttgtatggacatatatttcatttttcttgattggggatataggagccgaatcgataggtcatatcatgaactctgtgtttaaatatttgagaatctttcaaattattttccaaaataggtgtaccattttacattttcaccatcaatgcacaaaagttttaacttctccacatcctcactcacacttgttctcatctgtctttttaattatagccatcctaatgggtgtaaagtgatatcatgtttgggggtttatttttgaatatttacatcattccaaaaagaagtcccgtatctcttctctcctacatccccaaaaagtaggcaagaggtaatctactcaagaaatgataccagcttaaaccagggcagtaccagtgagaatgcaaagaaaataaaaaagaagaggttgttctgcgtgtcttacagatgcaacaggatttgctgatggattggatgcaaggtggcagagaatgagaatgcatttttcctgatgactaatgatgttgaacacctattcatgtgcttattggacatgtgtgtaaatcctttggaaaaatatctattcagatcctttgcctattttaattggattatcttttcattactgaggtttaggaggggtacttttaagtagtataatgtggatacatgttccttaccacatgtgggattcacaaacactcccattctgtgtcttccacctccactttcttgatggcacattcttattactcatgtttctgaaaacataatcttcagcctcattgaccaatgactctgaatattgactcatatatgtttaagcaggcttgtccacttactatatctcacaagtcccatggttatcgtgacagtccactgctatcccgtcccttgtggctgtctcatcattgtatggagacaatataaggatgccgggacagataaagggtattaggatagagtgccatcaatgtgtctgtgaagaagggttcgtttcaatcagttcaccatgactggggatttgattctgtcaattgctgactcaggaatgtaaatgctgagtaaggcaggacttgatcagtctattgggggaaggcatcattgaccaaagtgcagtgcaaatttattcattgactatgaggcatataactctttataactgtcaatagaaaatggacaaggcatccctccgttccttacaaggttttgtaatgagccctggatttaaaaaaatactagtaataataagagaaagagagggagacagagagagagagagtgagatagagtttctagtttaagtgaagttaaaatgttttttctatatatacaaaactagctttgccaaggaagatgtagtagtggttttcattcattcattcttctttcattcaagaaacagatattgacaacctgctgtttgacacatggtataacaacttccattgaaaatggagtagcaaacaaaacagagaaaaaatccccaatcctacagcatttctatccagtaggggaaaaaacaacgacagacaagtatcgtaaaatacacagtagaatatgatatcacaagtgctatggagaaatatttagtagagaagggtgctaaattagaaattttgtgccaaaattttgactaaggtggttatggaaagtttcacagataaggcaaaactgatgtgagggagtgatccatacagttacctggaggaacagcatcttgggctaaggaaagatccagtgcaaaggccctgtggccacagagtccctgagaatatcagtgcagctggaaagtagtggtgaaggggatagtagcacctgatttcagagatgtcagcatgagccacattttatatgcctttaaaggactagtgtattgttcttagtgagaaaggaaatggctgtctatgtaaaggggcattaggttagaaggttgttgcataatccacccaagaaataaaaggcatttcgatcagaatttagctcttctactccatgaaactacttatcagttccattaatgccttccactctgcactctcagggttcgattttctggaaaattttgaattttgattttgattttccagaacatttagagttctcgatgactctctccttcacgaaaaacattccttacttggtatctatatttgtttctttcctattgctgctaaaacaaggtatcacaacttgttataactctaatgttaactctagggaattaaaagcaatgcagatttattatctcacagttctgggtgctaaaagtcccaaatgtgttcacattcaaagagagaatccatttccttggtttgtctgtttgtcttcttttgaagactggctacatatcttagatctcattctctgtttctaaccttccattttaaaaaacaaacaaacaaaaaacattatgattacctagattcatccagatgaaccgggttaagttctcatcttaagatcctcacttttttttttttttctctctctgagatggagtcttgctctgttgccaggctggagtgcaatggcgcgatctcagctcactgcaacctccccctcccgggttcaagtgattcccttgcctcagcctcccgagtagctgggactacaggcccgcaccaccatgcctggctaatttttttgtattttactagagacgggttttcaccatgttggccaggatggtgttgatctcctgacctcgtgatccgctctccttggcctcttaaagtgctgggattacaggcgtgagtcaccgtgcctggccaggatgttcactttttaaaattgatttattcttattttattttagagatgaggttttgctctctcagataggttggagtgcagtgtcataatcatagctcactgaagtcccagcctcttgggtcaattgatcctcctatctcaccctcctgagaagctgggactacagacatgcaccaccacgcccagctaagttttatatttgtttacagagggggtttcaccatgttgcccaggctggtcgtgaacccctaggctcaagtgatccaccggcctcagcctcccaaaatgctgggattataggtgtgcttcctgacaccagtttctgaggtccttgacggctgtggtcatagctcatactacctctctctccctagtgtctaccggacaataagcagtttctgaatgattagccgttgcagggtttttgactccaaattgcaaaatgcaagctaattaaaaaaggagtgaatctatttactcatttttttttttttttagtttgagtgaactgattctcaaaatcagtgaatgcccagtttcatgtaaaccgtgtttatttccactgtttacactcagcagctgtttctttttcacaaacactggagattccatgttccccgaaatatctatgtatacctgtatcataattcattacacataggttagctggaatggagatattttatatttgtggcatgcatttgatcttgaattgaaacctgtagtttagaaaaatctacatatctttatatttttaacagattttgagaattataaaagcaaaacagtagagctctacggtagaatttttttttctttaggtctttccatgggtattttaaatgtctcattatgaaaagaccataaaccatggttttctaagagttctgctgaattttgcaattggctggcacattttctaaatgatcctgtaatctccatgtattagttttctagagcggccataacaaatgaccacaaatgtgatggctttaaaagagagaaatttactctttctcatagtttgggaaaccagatgttcaaaataaacgtgttggcagggctgcctttccctgggtggttccagaaaaagatccttccttgccttttcagctctggtggcctcggtgtttgtctctatcttcccaaggctgtcttccctctattgtatgtgtcgtctccttttcttataaagataccagtcattggatttagggttataccctcaattcaggataattttatctgcagatccttaactaattatatctgcaaagaccctattttcaaatagggtcacattctgagtttccaggtggacatgtatttttggaggatattacgcaacccactccacccaacacatcattattgcaatatatatgtatgaatataggtgtttcagatatttacactacacatgtgtgtacaaccaatgtattcaggatgccacctggctttctccttactaggccacactctggcaagaagatctaaggacaatctgggattcttcatctccttcttgcatcctctttgcttccaaataatgtagtcatgcagtatctgaaagtttatttcctgagcctttaaaacttctccatcagtttgacaaggagtaaaagcgtttttccccgttggccacaaaacttgtgcttttgctccagcaatacgcaaagctatatttcacacttccttcttaaattacaggctataaatataaagcaaaaccttttaccttggatattctttctgtcttttccctctgtgattaaatctgattacaaatgctcattaatgctctgccttggaattgcaatttgggcatgtgccatgtgaaaatggaggttcctaaaaattaaaatcaaagattaatgcaggttttaaaaaagggtcttattcaaatatatctcaagttttaaaacgactcatggacttttaatgaaatcaatggccttgtaatgcctcattttttttttcaaactcaactgtttcatagccttctctttagaacatatctgatttaccagaacccaagatttgtgagatggtgttattttttatctttactttttcctcaccccacggtaccatgaagagatcgtgtaacatcctttcctggttttaaagacaggtgagtaacgattacataacgttcaaacaagtcaggtgttctccagaagatggtgttaatggtgtctgattcacagatgctgccttgacccctggcggtggtaggacctatattctggtgaaagccaattttaggccatggattataggacctagatggagaaaaacgatacctaaacctcatgagatcttaattcactgatcggtggagagatatttttctttcagatggtatcatcttattgcatctccagcagagtgtttggccggtgaaaataaaaatggccattataaagaagttctttagacttttaaaaattttactaggatcatgccagaaattcctgctgtagaagtagatatgtatgtgtgtatacatatatatatatatatatatatttctgaatttgagatgttgggtattggtagagattcattcatttgaatggaaatacgcttgctttacttttggccagcatgaatgctctcatttgccacaggttggcaagcttattggtttaaatataaaggatcttgtgggtaagactaacagcaggttttcatagtgccaacatttctttcttttttattatcatatttaggaaagtctcttgactctgagatactttatattgtgaaataatagttctggtgcaagtatagattaatagattattaaacactttaagatatggatggaagagtacaactaggatattattaatgagtcccatttactattctttaatttgcagtggaattttcatttaacttttgaatataccaatgataggaagttagtagtgtttgcctgtaatttatcctgagctcatttatttgaagttcaaatttgaaagcttccttttgttgtttggtaaatagagattattgtgattcaaaatgagtaatccctaaattgatgtagaaaaagatatttgaggctgggcacagtgactcacgcctgttatcccagcacgttgggaggctatgggaggtggatcacttgaccaggagtttgagaccagcctggccaacatggcaataccccgtctctactatgaatacaaaaattagctgggcatggtctcacaaacatgtaatcccagctacttgggaggctgagacccaagaatcgctggagcctgggaggcggaggttgtaatgagctgagattgtaccactgcactccaccctgggcgacagagcaagacttcgtctaaaataataataataataataataataataataaaataaaaagaactttgagatattcatattgtccaaaaagtataattcaaatacttaatgcagaaggcagtaggatcactaaactacagactcattcatcaattataacagatggaagggtctttgttagagtcctggaggctgattgagcattttaaatggcaggttcataggggagatccaggaggtctaaaggtgagggtctacaagcaggaagcacccccactcccacccccaaattcatgacaacaacactaactaggcagcaaagggatatttcctgatgtcagcagtcagcagaatggtactgaaggttgctagataaatgcaagttttgtagtcactcacctgcaagttataggcaagatatttatctgtactcctacaggaaattagccctaattgactgctcttaatcagaacaagacattctaacctcttattcatggttagcagtatatcccacttgcttcactttgtgattctccatcacattggaataactggacgtgggatacatttggaattgagtctcaaattcaaatcgccatagaacctgaaaagaaaatgtaagaagagacaaaacagaagaaaaatgcaggatagagagttatgatttagatgtgttcattctgtgaacagagagcagattctcttggatctggctgaaacaggggccccctgtgttgtgaaagtggtgtatgtcttcatacgtgttcccacgggcctggacaaccaaccacatttgaaaaatgaagaaatgaaagcttgtggtcagggtcacaaaacttgacagtggcagaagtggatccaatttccagtcaaatctatgactcgttccatcttggccacaattatactgcaactcaattgcttttcttccagtcagtacccacccaccgaaatgtcagctcttcaagggcattaattgttgtttgtttcattcattgttgagtcttaggagcctgggacagtacattgaaaatctcaattgttgacattctcaataatacacaagaaatcatgttttcagatcatggaaatcatatccattaggatggctgttaataaagtaaacgtaaaataagaagttgtaatggagatgtggagaaactggaactctttcacattgctggtgggaatgtaagatggtacagtcattgtggaaaactctttggctgttcctcaaaaaagtaaacatggaactaccatatgtgatccaacaattctacctccgggtatatactccaattctacctctgggtatatactcaaaagaattgaaagcaggaattccaggagatatttgtatacgcagtccttaaccatgttattcacaatagctaaaaactgaacttttgaactagccaactatccattgatggatgaatggataaacaagtgatatatatgtatatatttatgcgtgtacacacacacacacacactgctgaaatggaatattattcagcccttaaaagaaaggaaattctgatacatgctacaacataaataaaccttgaggacatcattctaagagaaataagctacatgctagtcacaaaaggacaaaagctgtatgattttaccaatatgaggtacgtagagttgtcaaattcacagaggcaaaaagttgaatggtgtttgtgtgcggctgagaggcggagagaatggaaaattatttcctaatggatagagtttcagtttggaaaggtacaaaatgttctgaagatagatggtggggacagttggacaataatgtgactgttcttaaggccactcaattatacaccaaaaaatagtttaaatgatcaatttcatattctctatatcacagtaaaataaaacattatggtatctgtgatttaattgactatttgtaatcatcaccatgttagagcatgttcagtatctcatatcctgcaatattggaatggacatggtaatttttgagtggtagaaaataaagtaacttttaaaaacccatctctatgtattcacataatcttacatttcatataagtgaaatcatacactctatatctcatttctttctcctaataaaatgtttacaaggtttacaaggttcatccacattgtagcatgtatcaatcagtaccgcatgctggtttatggctggatactattccattgtatgatagaccgcattctgttatgtttatctatttttcatttgatggatatttggattcaattcatagagacagaaagtagattagtggttgctggtgcttggaagaggactatagggaattagcgtgtcatggttacagagtttcagtttgcgaacatgaaaaatttctagagatagattcacaaaaatgcaaatatactaaatgacattgaacagaacagtacactttaaaatggttcactttatgttacgtgaatttcctcttaaatagaagaaaaataaagtctgaagttgtcatatccttcactgggatgctctctttaaaagtgtagaaaggtcctgaaaggagcatataaacaaactaaacaacaatcaaacaaaacatgtcatcgtaccccacagcatcctgacatggaagactaaaaactgtcccagggctctcttcttccttatctgttactttcaggggcattttagcttaggatttaatttgactattgacaaccccagtgtctccatttgatctcagagcaaacttgaattgataattaaatttccatgcttttgaccagggaaagactttaggaaatgtctttgaaactgtgaacttgcagaaaggagaaaattttatatgtatctagcttctatccattccatttgtcatatggtcagaacttacatgatgcaagcaggccatttacagggccctgggctgacagctacatgctatattttgtatttgcttccactattttgttagcaaatgtatgtacttactaacaaaatacgtgttttaagaaataaaattattttaagaacaaaataatacaatgttttaagaaaacctgcttttatttgctttttattttttatttaaaaatgtttataaatttatgggtgttacaaattcagttttgttatatgggtatattcatagtggtgatgtcggggcttttagtgtactcatcacccgaatagtggaacctttatccagtaggtagtatttcatccttcatgccccttcctcctccttccacctcctgacactttatagtctccagtgtctattattctaccctgtatgttaatgtgcacctgttgtttagctcccacttataagtaaaaacatgcagtgttggactttctgagttatttcacttaggataatggcctccacccagtttcatacatgttgctgcaaaagacataatttcattcttttttatgactactactgagttgtattccatggatatataaaccatggtatatataaacatttatatatccagtcatctgttgatggacacttaagttgatttcatgactttgctgttgtgaatagtgtagtgataaacatatgagtggaggtgtctttttgatagaaccatttcttttcctttgagtagaaacccacaagtgggattgctgggccaaatgatacttctatcttaagtcatttgggaaatctccatactattttccatagaggttgtattaatttaccttcccaccaacagtgtataactgtacccttttctcagcatctttgccaacatgtgctgctttttgacgtttttcaaaatgtcattcattttcatttttattataattacttaaaaatgatgacttttaacagagaagggaaaaataaagttggtaatcttttgtagtgccatataatttctagttacaagaccacagataagtcccatgctgaagagaggtgggtaaaatagctcgtttgaaatgaagcacatttgggaagataaaattgtttttaggatgataacgatgtttgatgtctaactttggtctagtttttctaatgttaagtgtattcttaacatctgcccaaattattcactctttaaaccacatgccaaaacattacttacatttacttggtttataataaaatttgggactattagtggatgatatttactgcaagaattgttaatctggcgtttggatctagtatttagattactttatattttcagctgcatatgcaactattagatatctgcccacactttttccttcccactgtggaaaatacacactgtattaaggtgacaggttttcctattttcaccccttagacttgagttattttctcatcattattaactcatagaacctgtgctttgttcctggcttcagcttgagcactgtgcaaaaatttatcttataagatttggtcaaaactgttggctgtgtaggcacttcccctagtagaaacttcccctttcccctctgagggttcactgaaaaatcaacttaaaaaggcagattaattgaagaaaaggcatgcaaatttcctttaatgtggatagcttggcaggaaggattaggagactgattacccaatatcttaatggagtagatatgcttatatactctacttcctagaggaaagggaggtgaggactcctggatgatacttagggggatagtaaatgatttttaggggaattaagtgggcttgaagaacatacagtggcttagaacaaagtctgttgggcttgcagagcagacagtggtttgtcacaaaagtctgtccaggtgtgttgacagacttcattctttcttcctgcgatatgagtccagttactagaatctcggggaagggaccagaggtcattgttttcttctttgatgggtccagactttaggcagataaacaacttcagaaaacaacttcctcctgtgctttgggggtcacagagggttgagagacaagagggagtgggagaagatgagagagacgttgaggcttcttcttcagttcagcacatcaaagtgccatattttgctgtatgggtttatgagtcccaacaactgggtagtgaagacaacccagggctgtgtgttgatggttccgctgcagacagtcaaggctcacttctctgggaggaagctaaatgccactcagagacacatccccatctcagatgtctttgttatattgatgacagttggcacccagatggcatgtatcccttgtggtttcaaccattggttgacatgaccttaaaggcccaaggtatgtattcgttggtccattttttggaggaatgccattttacttccacaatgcagcatagctgttaaccattcatcatgccagtaagagaatccccgggatctgcattgggacagaatccccattcactgccttgtctcacttttgtagtttgttttgttttgtttgaatttgttttagtttttaacaaataatctgaaggtaaaatacaattgaaagaagcacttatcttatgatatcaggataagtaaactagtgcagtttcagaaacatctaaccaagtgttgttttcttgctggattgcaatattgataggcacatgggataatatctcatgtaaattctgaaacatctaattgcatcttgatccttcatcttgaccctcttctcagtgggctgcatttatccctaaacagcaacattctgtcaattcttaggaacgtgaaacgttacagtctgcagagcaaattaccagcaggagaaaatattactgaatattcaaaagcatgccttttgtgtgaatgatcttgaagccccagggaatgggggaaacagggttgggagtacataagccaagaaccttatttgatccagcagtttccggcttctaaaaccctacccatgcagttccaagaagaaaataacaaattggcatcacttaatgtttagtgatagaagaagaaaagcatgcctttgttcattttctactcttctcatttcctgcttcaccattcctatcaaatgaaacatttcgttttcatttcctctctataacttgtactatttctgtgaatagatgatgtgcttaacatattgatgtttgtgagtaaagatactcttgctatcatcaaaagaaatagtatccatttgagaagcatctagtatatgaggaaaagttttgttttcatttttcccttatgttgttttttatattttaaatgtagttgtaaaatgacagaacatgggatcacaaagaaacacaaaattcgtaattaataaatgtgattttgtatttattttaggtatgcaaggggcacgtttgtgtgggagttcaaaagcatttaaatattttaaatctcctttcattcatttaataagtgtcttttgaggtcagatgtaaacagacaacttgttacacatgtttcttgtttttagggaacttccaccccaacatgggaaataaacagagaccctactagttctttaacagtttcttaatgaaacaggatatttccctgaccccttcacaggtgggaactggagtgcactggtgctggaactagccggctgcttccaggccagcgggggtgaaccctgctcactcgctgctctaccccttgtgggaggggaagcacaggtgagcaggtacaggagccagggcgaacaattttgggcaccagcaagaatgaactccataccagccccacggcagcatctagtagagggtagcccgcaacccctgaagacccagaggaagtgttacactgcctgtttggctttgccatccgcagagaccgtaagtgttaacagctcagtggagggtcaatgtgacagccttttgcacccacactcatggcacgcaagtttttgtcctgaggtgggaaattaaagaaaaataaaatcaaaaagaaagagaaataagttttcctgtattaggctgacttttcccagaggcagcaacaggcacagcccagacccaggaaaagtcttgataatattatctaatgtgctctggagactctcccagcactccctcaacatagggagaaggaaaacaaattttcgtttgttttatggaatgagtttatagattcctgttctctgtaactaatgacttcaagtattctgttttatctaaaaagtacaacgaaggtcatgagaagcctgattaggcctgaactacagctgcttgggcaccatagtgaaggttatgaaataaaccagtgcaaggcactttagagcaaaacctaggtaacagacatctggattgcttggcaatggtcatatgcggtcctgagtttgtcctgcctctgtatccctgctttcacgccactgtaagcttacttcaagctagcccacccccttttgttaagtgtgtatgaaagacaagtgctgtctttgttccgggcccagtcgttggacgttgagtctgctgggtctgagtgcactcaataataaagatatcctcctgtatacaccccgaggtctctctctggtcctcctgatcccgcaacagactgacgtccaggagcaatcaggtcacacgaacaaattgaagatggtaaatgcaggggattttttattgctggttgaaagtagctctcagcaggaaggggaactgaaaacgggatggagcaggaagataatcttccccaggagtcccgtcatccccggccagaatcttctccaaagctatgccatcaagctgtccctctgaagtcaagccacttctctctgatgtccaactataatttccgatgtccagctgcttctcccctttccaagctatgcctggagtttttatgggcacaggatgtggtgcagggcaggccatgggtggttttggaaaaggcagcagtcgagtgggaaaacaggaatgtaaattctcactttgggccctggttgctttttggcttgagggtggggcacttaccgggaacccgctctcttctgcccagaatttccctgccttctgtccctatcggttttgtatttattttaggtatgcaagaggcacgtttgtgtggaagttcaaaaacgtttaattatttaaaatctccttttattaatttaatgaatgtcttttgagctcagatgtaaacaggcaagtacagcttatagctgcagtgaatgctgagaatgaagtactcaaacaattccagctgaacggggcggggaacagctcttctgagagagtgctgccccaagatccatccacctgaatatttattgagagagcttgtttaaactacagttcagatgaacaaaagacatccaccaggtggctctttgcggttgggtcatgaggcacatatgaccttgtaaaaaacactcaaaccacattcttaggaggctgtgttcagcactccttatcacacatactactccctgtcctgttttcagggacaaggagttctagtctcatgcacaaacaacatgcacacagtgcctcagtatttttccatgcctcgacctcacgtgtcttctacattagcttgaatatgttgccatgcaccccccacaggaagtcattacacatgtttcctgattttaggggagcttctaccctaacatgggaattaaagagagatcctactagttctttcaagtgtcttaggtaaccaattagatatattctacaccccttagtggcaagtgctcatgttgtcaaatttgcatttgttttcaaatgagattaaaacacaacaacaacaatgtttaaatgtttctactattagaaaataaaatcaatgtattctatcttggatttttcctttatttctttatagagttctggtttgcaacaaagttttatcagtagcttatttaccttcccaagagctcgggcaggatttgatggtgaatgtacatttagtggtttccatatttaaaaaaaaaaaaaaatgactctgaataagctcccaggctctcagtttcttctagttctttctgaaatggtccacaacatgattgttttgaaattgaaaaattaaatgcttttatttcaaaccccaccgatctaaaaccagtaggtgtacctttcatgagcacacttcattctgcaggtgaaaaattttcttccaacaattgtctatgatagtgatttataagtcagcaatttgctctaaagaatgtgtctctttctaagcatcacaagaagtaatttaaattatgctgtttcttagtaagcatgttgattgaacctcacatatttccactgattctacactaaacacagactctcttttagttgtactccatttgacttggtttatacagttcacatagtcacttttgtatgtctaaacttgcctgaccattttactagatggcatggtgatatggtttggctttgtcctcacccaaatgtcatcttgaactgtagttcccataatccccatgtgtcatgggagggagccagtgggaagtaattgaatcctgtggtggttaccctcatgatgttctcatgatagtgagttctcatgagatcagaggattgtgtaaggggcttttcctccttttgctcagcacttctccttgctaccaccatgtgatgaaggacatatttgcttccccttccgccatgattgtaagtttcctgaggactccccagccatgctgaactgtgagtcaaacttttttcctttatacattacccactctcgggtatgtctttaatagcagcatgataatggaaattgctactgagagtggggtgctgctgtgaagatacccaaaaatgtggaagtgactttggaactgggtaacaggcagaaattggaacagtttgaagggctcagaagacagggagatgtgggaaagtttggaactttctagagacttgttgaatggccttgaccaaaatgctgatagtgatatggacaatgaagtccaggctgaggtggtctcagattgatatgggtaacttgttaggaactagaataaaggtgactcttgctatgttttaccaaagagactggaggcattttgcctggcgttgttgttccatgatttttttttttatgttcaacaggacgatggcacaacctagctgcaaggcacagaccaactcccagcattgccagggcttagggtacattaccaggtcagctgctgaccagcaggggctgcttttctcttttgtgagtaactgagaattaaataaactaagtaacatgcctcaaatcctgcagagggttggagataatactggagtctcaacatagactatatgggaaagtctagcccattaatctccaggcttttttctaagaaaccaaacgccaatattttatttgttgcagaaaagggacatcctgtggtcaacacaatcttcagtgggagttaattttaatcaggttctttagaattcaggaaagctggaaaaaagaggagttgtgtaactcacatactgggaggcatcttctgtggccagtcagcagataccatctccattggagagatgcaggcatcttaaggatgggagaattccatttatagcctaggacttttgtccatgggcctggcttggatagggatggcccatattaatgtctttgactcttggttttattgttacattctgtatggctgattcagatttgtccacactgatatatttgttctctgattctgatcattgtggccatcttttcctagaacaaagggcttaggttaatttttgcggagtaatgacattttctgtggcagccaaactccgtagaacaatattgctcctacttcttgttttcttccaatggtaattgaacgtgcaagccacattcaggagtagggtctgaaattccccaagagctagccagcgataatagtgcaaatctaatacatgcccttgaaacaccaagggataaactcatgtgcatttgttcttttggggtttgaagaaccagatgacatgcaaaagaaaaatattgacaaaagatatctcatcgtttactttcaattattgagtttgattttcatgcattcaaccttagtttttttaagaggtaagtgattctagtttgtgagagccagaagcatgcacaaataaaccttatttaacaaattaatctcatattttcttggttctgatgattgcatactgcttattttaaaaaggttgtgagcaagccaaagttatcatacttatttttaaagtgacagcatggctgagctttcaaaatatgtttaaagattctaagagaaacaggttagaaaacaagatgattgacagctttttgggttattagatacagaaaattatacttagatttatttaggttgaaaattaatcctacagcatttaaaccagctgggagagcttgtgcatgcacaagagtgttcaagctgcaacttaaggccattgggcaacagtagaaagaaaaaaatggttatttcttctctttcagaaccaactgtgactgattaaccacaaaagatcagtgggggtattcaggcctaggtcgtcttggtggcaactggggttttagtttgctttcaggctcattgctggaaaaggctgttcagaagcttcctctacaacaagggagatgacagtgcgtgagtacaaagcagagaggtgcagtgctttctacagcaccgagtgggcaaattgtgcagatttttcagtagaatctacttaacaccaatccatgcatttgcattttattaaaatgaaactgtgatcatttcaactgcacattgcagacatgccctataaaatgtttgaagtcctgttttggacaaaagttttgaaaacatgcaccccgtatcaatttctctacttatattttgtatttaatttgtctaaagaatgccacattttcaaagcaagcaggccaagagaatgatctttttttcctcttttttttccccagtgtttaaaatgcaactgccatggggctgtgccattttagctgttggaaaaaataatctactatgccttggttgtatgtctgagtcatcagagcttctgggaatgattctttggcacattctaccaacaatttaacatgacacaaaatcattttcatatcttgtgatagtgtcagccaagtgtttcatacacatggtgctaggtgctgaaaaaggtgtctgaataaaattgttttcttaaaggaaccataggggacatgataaaaagatgcacaattatatatcttttttttttttttttttgagaaggagtttccctcttgtcgcctaggttggagtgcaatggtgcaatcttggctcactgcaacctctgcctcccaggttcaagtgattctcctgcctcagcctcccgagtagctgggattacaggagcctgccaccacacccagctaatttttgtatttttagtagagacgaggtttcaccatgttggcctggctggtcttgaactcctgacttcaggtgatccacccgcctcggcctcccaaagtgttgggattacaggtgtgagccactgcgcccggcctaaagatgcacaattacatttcataaattgagagagtttcctaaacaagagagagcatacctggaaatatcagagaaaaatacaaagggcttaaagatgttgtattaagcaaagttagactaaggcagcttggatgtgcatctcctccactttatgtttatacctaagtagagattaaaagcagaggaatttcaatttccacatgacttgtatatgagcaacagatgggagttctaactactgaccacattggcacatcacacaatgttttctttcaggtttctctacctatggcaaaaccagtgctgtattagagcctcgtgagctgtgtgttgttgattaattgacttaacctctctgggcctcatttttctcacctttaaaataaatgagtcttatggtgttttgaggatcaaaagagttactgtacaaacagtgctagtaagagtccctgccacatggaaaggctattatatatatatatatatacgtgtgtatatatatatatatatgtgtatatatatatgtgtatatatatatacacacacacacacacacacatgtaattttatatattaaatgtgtataatttataaatttttgtattataaatgtaaatctgtgatatatattaaaactatgaaatacagatcatgtaatatatactacctattgttttttttttaatttgtaaccatattttgaaaattttattttgcttataggtcttgaaagtcattccccaatcaacctttattaaaatccctttgattcattggagaatatcaatacatatgaggtattaatatatataacatatgtaactcttctgagtttataaatgtatgtataaaacataaaaattactaactcttcatatatatgtttgtatctatatataatttatatatatagatatatatacatatttgtattacatatgaataatcatcacagtgtgtctgcatttgttaatctaacctcctccaaccccacccccaaaaaagcagaaactaaaaatagaggaattttaagttccacatgatttatataggagcaacaaatggaactactaacttccgaccgcattagctaatcatacaatttttttctttcgtgcttttgttgtaaatatgatttttatttaagagggtattattgattatctacgcaagaattagccatgttctccatacttctacttcagttttttaaaaaaggatgaggatagaccgggcataagtggctcatgcctgtaatcccagcactttgggaggccgaggccggcggatcacttgagggaaggagtacaagtggcctggccaacatggtgaaaccccatctctactaaaagtacaaaagttagctgggcatggtggcgcatccctgtaatcccagctacttgggaggctgaggcaggagaatctcctgaacccgggaggcagaggttgcagtgagccaagatcacgccactgtactccagcctgggtgacagagcaagactctgtctcaaaaaaaaaaaaaaaggtgaaaagggtgaggattgttatttctgtgggcaggcccacacagcatcagattcctcagaaactgcaccggtaaatgggaaagtctttgagtccctctgacagagcttcaaggggctggctgttcattatcccacagcctcctttgctctgtgtaagtggaggctctgtgcctctgttatcttgcagtccctaggtgaccccggcagggagaaaaatcagtggaatcaaactcggtagcacagaaaaacgccccaaaggcaaggatgagaggaaagttgtgatcccacatatcaaagtcggactcttatctagatgggcacacctgagccacaggctggcaggctgagattctgcaaaggctctggaccccagataagcttgactgattgcattgtgatctcttcttttcatcaggggaggcgctgctttgaatgactaagctggatctgactttccagggaatcctttcagggactgtgaccatccagctatctttggatggctttgatgccctaattatttttcacttggttgaggatacttttaggtatctgttcatgtgtcatcttgtacagaaatgtgtgttctgggcttataaaaaaagtttaattgtaagacaaagggctctaggtttcatatttattcacagtctgatgaatggcacttatggatacgtacgtgtatacagtaagtgctcactgaatttctcttgagtgataaactgggatacaaaatgtcagaaaagaaagagtgaggatgggcactggatccagatgtcagtgaactctgagggtctcttgctggttaaaagaacagggtacttttattttcattctaaaccctgcctgacccttgcccttatatcagtgaatcaccatctcgatggcccctcaaacatggcatctttgaagtagagcctcattgagaaggactccttagaagtctgtcatggctactaaaattcatatctgtgctttgtgcctgagcactagtacatgtgtcagctgtttcttaagcctacattgaaccattaggtaaagcccagtgtgctcccagttcctaaaatctggtcaagtcttgatgttggtcaacatcttgcctggccccagtcagatgtctccagctatctgtaacaggactcagtgtcttgtttacaaaatgcattagtcatatggcttcgttgctggctttgctgtataggtcaggaataagtcagaaataaccaaaatgctccaaatcaagttctagctgttttgataccaacatcttccatcaacttcgcttctccctgactcatctgtctgtctgttcctgtgctcttcgcacacagaggcaattttgtgtataaagctccccaagggaagaagaggacagtgccttcatgggaaactcctttctcttaaataggatttgcatacttaaccagagcatttgcttcagttaaccaagtgagaggtggagaaattcttgcaaaactatagctacattgagagggattattaaaagtattgactcattcattagaggagctgttacaaagattgtagcaaccaaagcaaaataaaaaatattgccaaaagtattctcaaacgtattttaaaatgtccaaaatattgggcaagactaacatcaaagaaggtatatgttttgacattgatttactaactacttatcagtgtaagtaaatacaccttcaagcacttatttaggattaaggtagtcaagttatatgagttgtatgagtatgtgcaggccacaagggttgcaaaacatagtgaattcaatatccctctgccatattgaatatccttctgccgaacttctgcatcacagttgtggcctgcaaacaggtaacagttgtctgccaatcccttagggatcactgcattctatagggcttgaccaggaagtaagaggctcttcccaataagcgatatcgttatggtccttgtggttctgctaagaatctcagagaagaaatgaaagatacatgaaattgtttgcatgctactagctctagtgggtaggttggtagcgtagttcttcatggcaaaagacagaatatatccaaaattttcaccattttgcccctggtttgagggatgcatattcctttagaccattatgttgaaaagaaagttaaaaataacataagaagagacctcctaagttgtttaatccaagccctcaatcttagcaagtgcctggtgtaaaatgtctcattaggtaattacccatctcctgtctacccactaagaggttctagtaaagtacatactggctggattcaataaagcacaaataggcagcaaatgcttcttacatctcaatctaatcggtagccttctttatcctcacccttggctgactaacgtgcataaagcataggaattctggccactcaaggatcttaaccatccagttcagtctgttgcaatttctcctccattacaaatttttttcactttcctttcctgggaaagccacagacaggacaaccattcagtgagaaaggagtgtgaagctgacgtctttcctcactaagaggagaggggccatgagaggaaaaggcaacttcttgcgtggctggtggtagagttaaagtctgatgctactgtcttctgggagcagcagctgtacacagttgaactttactttggaggcatatatgatttccagggtttctgtggcaagttccacccactgcagttcatttgacttgggttgaatctctttcctccctccatcacttcagctgaacctcttctgtgatcctcacctgttctctagaggtgagaccagggcacagtccctttctagatgaccaaagagcacttctttctatgtggttcacatttggctccatcaccatcgtagctgacagggccaaccctccggcatcttcatccttcaccactgtctttgctgtgccccataaggcctgaacaaggctgatgggccaagtatggtgtggccagccccacagtctgttactaggccttgctttggtagacacacttcttgatttagaaccatggctctcagtcatgggcagttgtgccctgcttggcaatgtaaggagacatttccagttgtcagagtgagtttgaagggtgttaatgcacttagttggtggagaccacggttactgttcaacatcctacaattcgtaggacactcatccataacaatgatctgattccaaatgtcattgatgctgacattaataaaccctgctctaagttaatgtttttttcttactcatatttaaaatgcttcctctagctaaaccattagcccccagtgaggtataagttttcctctccaagggacatttgactatgcatgtacatacttcgggttgttacagctggagattggtgatgcttctggcatctaatggatataagtccaagatgttgctcaatatactgcaatgcagaggacagcccacgagaacaaggaattatcccattcataatgccactagtattaaggttgaaaaaccttggtttagaatatggggatacttattggtgctccctaaggtgctatctgaaagcagctttgaagacaagcagaggctttgaagacatactcacagggtatgatatagtttggatatttgtcttctccaaatctcacgttgaaaactgatccccagtgttggaggtgtgacttggtgggaggcatttgggtcattggccggatccctcatgaatgacttggtgcagtcttccaggtgatgcctgagttcttgctctattatttctcaggagatcaggttgttaaaaagagcctggcaccttcctctcctctctctcttgcttcctctctcaccatatgatctgcgcacacagcagctccccttcctcttccaccataagtggaagctccctgaggcctcaccagaagcagatgctggtaccatgcttcttgtacaccccgaagaactgtgagccaaataaacctcttttcttttcttttttatttttctaattagagacaaggtcttgctctgttagactggagtacagtggtgcaatcatagctcactgcagcctcaaactcctaggctcaagccaccctcccacctcaacctcccgagtagctaggactacaggtgcatgcctccatgcccagttaattaaaaaaattgtagggacagtcttgctgagtttcccaggctggtctcaaactcctgacctcaagcggtcctcctgcttcagcctcctaaagtgctgggattacagatgtgagccaccatgcctggaccgtcttttctttataaattgctcagcttcaggtattccgttatagcaatgcatatggagtaagacattgtacaagtcccactttgggcacgtctagatctgtctgtgatcctagacaagttatgtaatctctctttgtgtctaaacctgttgtttgtttctgtctttattcctcattaggtccaactctaaagatagtaaaattataggtataaatggagttaagaggggtgccttaccaagagtaaaccctccaggagtgttattctgtcagtatgacttggtttttagctttgaaacttttagcatgaaactaacatggcaggaaaaggcctaaattagaattcttcacacacaaaactccttctatcaggaggcagcccatctgttgtcaaataatcctactcgtagaaatgtattaaatttttcttttccttcccttttcccccttcattaaatggaattagattgtgacactatgaggaaattaaagtgaaggtaaaataaaacaaacaggaagaagtctgtcttcagattggatatgcaattatcctgtctttactgctgatttcaattataactcattggtgttaccagcccacgatagatgtcccctgcctatgtggtgtttaaatcaagtgttggcatcattcacacttgtttactgttattagcactgatggatgtaatcttcatgtcttcctctgaacactgcatgctgagaaaggggccttatttcctcgtggattttctaggcaagagaatgtcaggccctcacctgtcctatttccatctcactcagcagaaaacacactggctcatggaaactgcaagcatcgttgtcagctgcacctgcaggcaccatggggttgcaagtcagcatcccctttcagaaatgaggatggaattagaggtggaaagaaaattctccacagtcctctcacttctctgggcttagacagggaggtttctgctatgttttcattgattatgctgtggggggaagggagaggaggaatcccctaagaagaacaatgtctcattggatattgttcctttgggggaaaaaaaaaaaggaaaggaaatattttcattttttcttactttttctaccctagaatctcaatgccaccttcaaacatttgaatctcacagggagaaggcggccacatatttcacccccaaatgctaggccatgtcttctcatgtcagaaatgccctattgtgcgtgtgtccttgttgcaagccatcttagacttgttgtttcagggatagggaaaccattctgcaatccaaataaggttgcatttcttgcaattcaaaataaaaggtgtgcatgcacacacgcatgtgctggtattattgtacagcttgcgtggtgcaaggctgaaggctaagggactaatggaggctgaaatttagccctagatacactctgcaagctgagtacctgtggggccgtattacctggctagaggtgtgcctatttctcatgcatccagtatcaggtacttttctgacttagagggtccctcaaccctctcctccttcccctccacctatcgtacttagcatactgtatatttgcccttagtctgtttcatccaacttgatcacttggtagcctgtctttatccccactgtctaaatcagtatttggaatgtagtagggacacaaaaaaaattagttgaataaaggaataaatgggtgaaatagtgaatgcatgaaaaaggaaaaaatgaatattttggctgctgtgtattcttgtattgttgttatatataattcttctgcctgtctttcttcatacatacctcattattagtataaactaccagcattcgtgatatgcaggtctttgcttttgcagagagccatgggtttctctaaaaggcatcttgcagcctcccgcccagggtgtctctgtgcagctaacctggttgctaatctctgcaagctcgtactttttctgcagcacgtgattctgttctcatttactcttgtaatccttctgtttccttctgaccagcttgagcttctgtatctagtgccttgacgttctctttctttcttggtctttttaacattattatgtcagttataatgtttttcagttgcttttagtattcagaaaattcttgaagccttcttattgcccactggtattttgtcttcgccgcttgttgtttgggtggatttagatatagcagagagagagagagagagagagagagagagagagagaggaaaatagagacagagatatgtaatccccccaaccaacccccgttatctgtgatttccattacccatggttaggttagtacagtacagtgatattttgagagagagaaagagacatcacattcacgtaacgttttattagagtatatattgttacagttgtattttattttaattgttgttaatctcttactgtgcctaatttataaaataaacgttatcatgggcatgcaggtataggaaaaaacattgcatatatagagtttggtactgtccacagcttgaggcatccaatgggggtcttggaaagcatccctcactgcccctggtaaggaggagctactccagttttgagaggagaaactaaacagatatgaaaaacatacaagttgtaacctaataggaaaatttttaaagtgttattaaaaaccatatcttatatatctcatatattaaaggacttcacaatggactttaggaaattaagatggaagttgcaatagcaaaagtttagcaatgcgtattcttacatatgaaaatcaaaattaacctagcagtgttctgagcaacttcactttaagaagtaaaactagtgaaatgataaaggtatatgggtgctgactgttacgtaattaggctgatataatttagcaaggatatcagaaatcatatacccaaaatgagctttattatattcaaattagtcacttcagaggcagtacactaattacaataaggtaagactgctggaaacttctttatttctcctcactttaaaacgtttcagagcccatagtaatttatttttaatatcttgctgaggcaagtcttaatccttaaggaggcatttatatttggatacagccagggttctgttgagtaaggtcagtgaccacattgtataacacaattttaattcaaagacaaggaacagctataaataaaggtgagcttgtttcaactaactcttttttatttttttttttattttttttattttttttatttttttgagacagagtctcgctctgtcgcccaagctggagtgcagtggcatgatcacggctcactataacctccacctcacaggttcaagcgattctcctgcctcaacctcccaagtagccagaaatacaggcacgtgccaccacgcccagctgatttttgtattttttttagtagggacggagtttcaccatgttagccaggctggtctcgaactcttggcttcaagtgttctgcccgccttggcctcccaaagtgctgggattacaggcgggagccaatgcgcccagcctcaactaaaccttaaggcacattgaaaagaaaatcaaaatgcattgagctaaatgccaggcatatgcctttccaaatggacttgccatgaaggatgtcattcctgtgcagccaggtgttgtcttctatgtatttttagaatgcccatcatatagtctcaccttttaaagtctgtttagtggaatgttttctaactttcccatgtacctcccatgtcattttttgccagttctgccttccctaataaccaatgaaggtacttgcttcatgttaaattctaggtaatctggtttctactgaattagaacattcccacccgccaatgtctttgaataattaaaggttttataatgtggtttccatacaactaactgaatatttcatgtggctagataaataggtaaattgcagtacagtagcaattggtgtagacacttagagggtcctaataaattattgcacacgccaatgtgcaatcagaaagaataactgtagtgttaagcctcagacaatgctatagacctgaggatgggcctgtgatggacggatcaatggctcagttcctattggagtttcacatctaggaataagtgaattcacgactattcatcagctgctgctactgtacggaagtgtgtccattgagaagttgcagaaggggctgggagattggataaggcttttgcagtacccctcctttttaaaaaagcagacagggtgtaactctattgcaggctggagtgcagcgttgtgaccatggctcaccgcagcctccaactcctgggctcaagtgatcctcctgcctcagcctcctgagtagctaggactacaactaggcaccaccataccaagctaatttttttaaataaattcactgagacagagtcttactatgttgcccaggtgggtctcaaactcctggcctgaagcagtcctcccatctcagcctcccagagtgctgggagaacaggcgtgagccacggtgcccagcctcaataccttttaaattaacaggaagtggaaaacagaaattctgcagcatgtttttctcattagcatgaatcactctctggtgatgtgttcatggtttctaatggtattttcaagatggacaatataaagacaaccattagaaaccacaaataatagggccatatgaaacaatataatagatgcatgaggttaactggtcaacatttatgctgaacttagatttacactgattaaaaaaaataatccatttgaagtgtaacacacagaaaccaaagttctgtgtgttctgttatcttatattatcaatgctccatgcaatgtgaaagcttaaggcaagtgtttctataaccaacacccatgtgaagaaatatagtttccatcttcaaagcagtgcatgctcttttcccattctatctccttatcctcctccgtgataaccattattcccttttactactcatttccatgcttttctttatattttcccaatgataaaggcatccctgaatcacataattaaattttgcttgtttggagactctaaatgaatgcaactttctattactttctggtgtgtttttttcatgcataatactgttttataaatttcatatgtgttgctgtgtatacatccattccactcattttaattgttgtatagtgttctaaagtctgaacataccacagtccctatgtccattttattcctaatagatatggttattattttgagtttgaggttattataaattcgtgttattaacattctttttcaggcaccctcctttctcacaagcattggttttctgagacatataccattatggaattgctggttcaaatcttcaactgtatagtttatataaggatgaactgttttccagtacagaaatgcctgttttcaccaggagtgtgcaatcttcaacatgtggcagtataaaagttctattttatttttctgatctagcgtgtgtacatggaaacccattgtgtgttcactgtgtttactctgaggttgagacatttccatatatctcttggccattcatatgtcctgtttggtgaagcgtctgtttttgatctgtttttctactgggttgtgtgtcttattgctgtatttcgattagagtgcttcactgattatatatgttgcaaatatcttctgattttccttccatgtttttaatgatttatttaaataagctaaagttcttaatgttagtttatagactttacaatattttctttcagattagtgctttggaatttttgtttaggatatcttttcctaccaagagatatgaagatttccttttattttatctgaaaaaagcttaatattttatctttcatattgaaaccacacagggaatatatttattgcattctgtaagaggtctagtttatttttccttagaatatcacaatacaatttattttaaacagtttgatccatgtcactaaagttcaagtgatctctttgtctacctctgtgccaatcatcacatttttatcttcatgattttataataatccgcaatttatatttttatactttgtttatttcttgccaatatgcattgcatccctgagaaaagtgtttattttgcgatggttggtgcaatgtgctatatgtctaatatctcaaactgttgaagtatgttgttcacatactctatatagttttccaggtggtagtttacatattctttcagtaactaaaataggtctattaaattttcccacgatgtttatggatgttttaaaatcttttcgtatatttttccaaaatttagtttcttgcattttatatgcttatgaattttagtggatacagtctagaatttttattgcattgtggcaaattaaggttcttctcattataaagtgatcctctgtaagtctgtggtgcttcatgccttaatgtctgtttagtttgacgttaacattacctttgttttgttagtaatccaattgtgtatagttcccatgtgtttacttcaggcctttctgttgactcaggttttgagtcttttctacatagcgtctatttgggtctcataatctttgattttcaaccgcagatccactgatatttacttttatttttgatatatttgtgtttaagtcttctatcctaaattgtgctactaatatcccacttctacatcttgcttgaattgctttttaaaaaatcattcaggccaggcacagtggctcacacctgtaatcctagcactttgggagaccaaggcaggaggatcactttagaatcctccaggagttcaagaccagcctgaggaacatagcaagacctcatctctatgaaacataaaaaaaaataaataaataaaaaaaataaattagccaggtgtggtggtgtgcacctgtagtcctaggtactccagagataagagttgacaggagagtctgatcccatgagttcaaggctgcagtgacctatgatggcaccactgcactgcaacctggatgacagaacaagatcctgtctcagaaaataaagaaataaaagacaaataacattactccatttccttcactcccacttctccctctacactagatgttaaaagactgtactagttttagtaaataaccctagaaattacaacacagatccttaatataatcactaattttaattaatacattttccacttctctgaaaatacccagtagtcagtgtattttagctccatgtttatgacctaacctacttgctgttagtacctttcaatgttttgtgttttttaggaatctttttcagatatgattgcttatcttattatttcaatattaattttgattttctgatgattacactattttatttatgtttcattactttttgtacctcctacttttatctgtgattattgtcttaaaagaatctatcggtgatctaaaatatattttcagagctaacaagctgttggaaactctgtttgcatggctaaatgtgtctttatgacatcctcttcttgaacaatattctcattgaattttaatttgcaattacttctttcagccatctgagaaatcattctcctattctctggattccattattggtatggagaatttagctgtcagtttaagtgttgctcctttaaaaataatatattttctgcagatagtttgtctatatccccctgatacctttaagatagtttttctttgagtttctgccgtttcactgtgataccattaggggtttattaatctgattggaattccttgatgaccttgaaatttgcaatcgtggtttcttccattctgaaaatagtcattacctcttcaaattttggtgctgtttctcttgttttcactctgtttgcacataatttagattttctccctctggctccttttttagtctttttttttttgtattttgtattaaattttactttcaagcttcattctggattactttttctcaagacctataatctatttcattaattctcttttctactgtatctaatgcatggttaaaccaatgcatcaaatctttatgtttgatatatattttcattacatttcaaggattaattttagtttcttcttatagtttccacattttcgaagttctcaattttatattttctggaatgcattcttcctagttattttaaagtctgcattttgtatttctatttttttcaatcacccttttgtttctttctcttttttgctttttggtttcattgactaatatcttcatggtctaagtattataattatgcatatattagatattctcatattgttttccttatttctaactctctattttatattttttgtatatgacagctccctgtgttgcccaggctggagaggttgtgctctgtgcccagtggcacaatcatagctcactgtagcttcgatctcttgggctcatgtgattctcctgcctcagcctcctgagtagctgggactacagtcacatgccaccatgcctagctactattttatactttaaaatttttttagagactaggtcttgctttgttgcccaggctgttctctaattcctggcctcaagcaatccttctaactcagtcttttgaatagttgggattacaggtgtgggccactgcacccggtttcccagcttttttcagatttccacgatactctctggatcgtttcttctcacctcttctcaagtttgtccatttttctcttcagctttgtttaatctgcccttaggtggacccattcattttctcattttgtttatttctctgatctagaagtttgatttgatttttattttttcatttttaatactttcttattccctgcagatgttttccaactttttgttttcaagctttttgaacattcttcaaaaaattggttatcatgtatatattttcatggcatcttaattcctttgggatttctgctggctcttgttggtgacttcttgtttctttcttcatgggcttggtaatcattgtgaattggccattgtatttgcaaatggattagtggcatctttctccaaagcagataacccatgggtagcgaaattctaggttctttcatccatggggccatgctcttccctgaattgttcatagatgttatgaaggtagactgcaagcacttgcaagactgaatttagttttgtttcatgtttgccttgagggtgaaacccatgaaggtaggaaaatgttaaaggcaagtatattagattgggaccttcaggcgtgactagggtctgagagttgccccattacatggtgatgctgcaagaactcccacagtttcttccagattggaacagtgcactagggcaaaggctgctttgtgtgctgggcatctagctggatcatcatttggtcgtcagtgtgtttttgtttgtttctttgttttttgtttgtttgtattgtgttttgagacagggtcttactgtgtcatccaggctggagtgcagtggcacgaacagggttcactgcagcctcgaactcctgggctgaagacttcctcccacctcaccctccccagtagctgggaccacgggtgtgtgccactacgcctggccactttttaaaaaattttttgtagagacaaggtttcaccatgttgcccaggctgtgataatcagttttgaagctgtaatcttaaatatgattttagcactaaaatgtttttaagagacttaaaaaaatcacacatattacaatccattttcaataagaaggttggtttgaataatctactctgttactgctagatgtaggcttctgatttattctaatatattacagaaatgagtaggtggaacatgagtttataaagataatgcaaatattttattagcactgtattctcttaagagcagttcagagttcaaagaattgtgactttatttcacaggcattaaaataaattaaatcagcaatctcattcctaacaactcaaacttcaaagaaatttcagacagttaatcatcacctgacaccacagcctatgcaacttgggtttaattaggatttatgttactggtagcattgtggttgaaaagatattttcattaacatttctctctgaagcactgagtcatactcttgtttattcgcaagtttctttacacttttcaatcaatatttgagtgttccttgggaaatgtatgtttggctattttggtgtttttgagagtgtttgatctttgaaaatgcatgattaaaagccattttagaaataaacatgagtgttttaaatacaaattactaaagccactgttttgtttcaaatttagggatttaatttttttaatgaaaatgctcctgtttatatatgcatgaggttatgtaaggtcatcaacttaaagattgatgatggatttagtgccagctgttgattagtatgtctgcaatcaatctacaacatagcaataacgctagctaccttggagagttactgggagaaataaataagacacaatgtatgtaattggcctagcaaacttctttgtatactataattattcagtaaataatacccttgtgattatttatctatcaatcagtcttagagcagtgaatttacctttaaaatctagacacattaggaaagaataatggtagattttaagacaaaattaaaatttcttggtgtactcaaaaatatatattttctgttaatgcaaattaggcttttatatttattatttttaatatttgactctggaatgttttcaaaatttagttgagtagatcttaatgcaagtctacttttaaaaaatctcattatctagtaggctttactagtaattaatttgaatttggtagacatgaaacacaccaatttcttgtacacaatcataaatcctgtatactatgtatactctgtatgcctgtatcttggtgaagtgggaattaaactttatcaaatttccattgaaaaactgaagagcaaactaagatgtaatcagaatgttaataaatattgtagaaatggaaaagtttcagaatgtttagatttctcaaggaaatctcaaagcatgacacttttcattggtctgtcatggataattaggtcttttgctatttttatttatttatttccaatccgtcacaaacgtactttggttgatgcatatatcaactatagagtagtaaatctgacaaagtctatgcactgaaaactatactctgtcactgagggacactgatgaaggcttaagcaactgggagacagactgtgttcacaaacacaacaccctcctgagaagatacaatattgttaagatatttattttgtacaaattaatctacagactctttgcaatcccaaataaaataacagtagacttttagaaaatacataaattaacaagataaatttaaaattttaatgaaaatacaaaagatctacaataaccaaaacatttttgtagcagtagaacatacttggagggctcctgctacctgagctcaagacttagtatagagctatattaattgaaacagcgtattattgacataaagatgtaaaacctgatcaatatcatagactagagacaccacatagaactgtacatatatggacaatgaattttccaaggagattcaaaggtaattctatgcaggaatgatttttttttcaagaaatggtgttggaaacattaagtatccatatacaaaagaaaagaaaaagtaaacaaaaagctttgatctataactcacaatttgtacaaaaaacaactgaaaagtgagtcaaatacctagatgtaaagcttaaaattgtaaaacttccaggagaaaaaaaaaaaaaagaaaaattttgtgactttagattttggcaaatatttcttacttaaaacaagaagcttgatttttaaaggaaccaattaatacattggactacatcaaaacttaaaaaaatgcttatgctacatgaaagacattgctaagggaatgtaaagagaattcacaaactgggaggtaagataggcaaattaaatatcggatgaaggtattgtaccagtataaatgtatgcatacatacatatatatgatgcagtttcctataaatatatagtatatatggtattagacatatatgtatagacacgtactggtacaattatatactatatatacaatattcatatatagtatatatgatacagtattgtatactatatataaaatatatcatatatttaccatacagtatactacacatatgtatatatatgatatactgagtatcactattactaaaaattacagaatgtgaactatgaaaatgtaaaagcctatttaaataaaataaatatttaaaatactgtgttttttatatatatagcacatgtagtatactaaattgtatacagtatagtatatatagtatactgtatcatatatattgtcaatatagtatataatttacccctgtgtgtgtatagatgtgtgtatatgtgtgtatatatacacatatatatgtatgtgtgtatatatacacatatatatgtatgtgtgtatatatacacatatatatgtatgtgtgtatatatacacacatatatatattctaaaaggagaattaaaaagaaaccaccccataacaattggacagaaaattgaacaggcagttcacctaggaaaacatacatatgaccaatagcccaatgaaaatgtgctcagcatcattagtcattggataaatgcacaaatgaaaccacagtgaaataccactacacatctgagaatggctgaagccacaagactcgctatgccagggcttggtgaggatttggaggagctagagtccaccccaagctgctggtggggaagtgatatgaaaccaggacttttgagaagagtttggcaatttttttgttgttaaacctacaagtaccatgtggttcagccatttaactcctaggtatttacacaagaaaaagaggagcatatgtccataccaagaccaagaacctgaatgtattcataggctggaatgcttctgagcagtaaaaatgaatgaactgttggtgcatgctacaacctgcatgaatattaaaatgattatgccaagcctaagaggccaagcaatgaagagaccgtaattctgttacttcgcttttaatattttggaagctgtaattcataatgcctgtctgtaagcagataactgtttgcctgagatgaggaggaggagcaagagatatagattataaagggatatgggtaaactttggggtgtgatatatatatatgtacatgtatatatatgtgtgtgtgtatatgtgtataaaatacacatatatgtatattttaaacagagtctcactctatcacccagggtgaagtgcagtggcacaacctcggctcactacaacctccacctcctgggttcaagcagttctcctgcctcagcctccccagtagctgggactacaggtgcatgccaccacgccctgctatgtgtgattgatatttctgtcaccttgactgtggtgatggcttcataactgtatacataagtcaacatttattatactgtatactttatgtacagtttatacttttacaactataacttcagaaacccactaccctattttaaaaaagttaataattactctcagccactgtgagacctcactgtttccttatgctcatttttccctttaacaacaatggggaactagtattttatcagataaaaataatgtttgataggattttgtgcaaagtctgttttgcctactaattctgccttatggcatctcagacatgtaaattagacaagagccttcagtatgtctgatctgttgtcacgttattttccactagtttgtgtgatttagattatttttaaagagctgataaaggaaaggaaaggaagagagagatagaagaaagaaaagagagaagaaagagaaagaaagagaaggaagggaaagaaagaaagaaagaaagaaagaaagaaagaaagaaagaaagaaagaaagaaagaaagaaagaaagaaaaaaagagacgcctgtctttttaattccagttggaagcagctttagttataaaatttccactctctagaatattcttggggaaaaaatgaagtgtcaattaaattgatttttttaacttgcatcctatgtctctgaacatgattctttttcaatcaggcatgtagttattgaggacccatttatgagctgtgcatacatcccatccaattccatccaattccgtccaatcctgtccacagacatgttgaaagcatgagcttcctgcaagagcaatgcaccagccgttttcctagagatgggtcttcaaagagagggttctttctcggagcacctgctcagggaacaagactgactttaaaccagtgttagcaatatgcatggtacactgaaccatctgctggaggacctccttgtgtccaacacagtccttctgttgaatgtcatggaaaagactgagggttgaagcaaatcattttatgcagtgaggagaagaccgtgctcatctttcagtttttgagccacatctacctaatttatagtcaggtttggtagcctcagcactactgatatttgctgcataaatctatgctttgttggggttgtcctgtgcattttaaggtattgaatagcatccccagttcacacccaccagataccagtatataaatatataccgtttttgccaattaaaatgaataagaaaaaaatcattgttacagattaataataataataataattaataataagtggctggacacagtggctcatgcctgtaatcctggcatttgggaaggccaaggcaggaggatcccatgagcctgggaatttgaggccagtctgggtaacatagtgagaccccatctctaaaaaaaaaatgaaaaattagccaggcatggtgatatgtgcctgtagtccaagctactcaggagactgaggcaataggatcacttgagcccaggtgtttgaggctccagtgagctagctattgatggttccactgcactccagcctaggcgacagagcaagacctggtctctaaaaaataaaaataagtaaataagctaaatgctcttgaactgaaaaaaagaatgtattctatgagagatacctgataatcacctactttgaccatgtttttatccttcaaggatttcaaactgttacaacaaacttctaaacgtgtatctctttagttcagcttccttacatgaatttaatgctccagtatgtgagaccaattattgatttaaaaaagggtagatctgttttaaaattcctttaccaatattcctcatgctcatgagaaagatatgaggcagtgctgttgactgcatttgtatttagttaataccacgagcaagtgggaaaaattcagaagtgacactgagttggtcatctctcaattatcatcatgagaagtacgcacaatgtgaacattctgccatagggcttgtctctgtaaactgctggtcaaggggcatggacagattctactatttttaaaaacatctttctgaacagataacggaggcttaattgtagtgtaaacacactgatgtacaaatctcgaaaaacataaaataaagtgtgttgagattggaggtgctctgttcaactttcgagggatagaaaatatgcctatcagctgtaaaagcggtgcatttattttcattttttgagaccaacactagagcagaaagacacattaacaaaagggtaagagtcttcagagcagattactcccacttgaaaaatgagttaagtgatttcacagcgggagagagggatatttgcagcaagaagtttcattagtcactgaatgaggtttctctgacatatattttcacagaatgagaagcatgatctttagaagcaagagccataacctttctatatttttcttctgtttattcattttgctggaagattcccttccctagccttctggaaatttcagccttctagtctgatttggtgacctttgttcactaggaagaacatagtccgtttctctttgccaaaaggtagttgcatgcatttgcaatttaaacaaggaacatccaaaaaaattagaatgtgtgtttgttgaaaatattgtgattattaaagtcagagaagatagctaaaacagaagatgcccatactttgaaatcagatgattattaatagatgctgctttgtgttgactggagtttaactgccagtcctttcttttgccaagatattttcccaaaagaaacatttcagttgtaggctcaataaggagactggaatctgctttgtgaattggtggcaaaaggaaaaggtggggaaggtaggagaagaaaagagagatggagccttcaggtaggagactactttttcttcctttggtgtctcatcttaatatttaaaaaattaaattgaagactcagctaaggtatagaaaatatcaggctttttctttttgacatataaccaacattatctcttgtcaagcaatttatttttttattttatttttttaattttctaataagactaggtttattcagtaccctagtaaaagtttttattataagtatccaacagtataaaaagtacaaaacagacctgtagatttctaatatattaatacaaagtgcttattttttaaactgctttttttttttttttttgaaacggagtcttgctttgtcgcccaggctggagtgcagtggcgccatctcagctcactgcaacctccatctcccgggttcaagcaattctcctgcctcagcctcctgagtagctgggattacaggcacccaccactatgcctggctaatttttttgtatttttagtagagatgaggtttcaccaagttggccagcctgctctcaaactcctaaactcaagtgatccacccacctctgcctcccaaagtgctaggattacaggtacatgtcaccacgcccagctaatttttgtacttttagtagagacagggttttaccatgttggccaggttggtctacatgatgacttcctaaacaagtgcataacttcgattctacaaaagatgacagaattcattagtactactcgtttgtcctcagttatactttctgcagtttcagttatctacggtcaaccatggtctgcagaaaattccagaaataaacaatgcatcagttttacattgcccttggttgtgagtagcatgatgaagtctccagcagtcctgctccctcccaatccatcctgcccaagaggtgaatcctccctctgtctggcattttcatgctgtagagactgcctgacccttagtcacttagtagtctgctcagtgaccagatcatctgtcatggtactgcagtgtttgttctcaagtaacccttatttcagttaacaatggccccaaagtgcaagagtagtgatgctggcatagtgttataattcttctattgtattattagctattattgttaatttcctgtgactaattgataaattaagctttatcataggcatctatgtataagaaaatgcacagcacatataaggttcagtactatctgtgttttcaggtaaccactacaggtcttggtacgtgtcccccgtgggtaacggaggactcctattgtctgtgttttatttgaagggattttgattcatttgtgatctgtttcacgccctcttccttttctcctctggcaaatttgagttggcatgccctccacttaatcttttaaatgcttgatccattctattctgcagaagaatgttaaatttttcattatgtcagtcaatatgcttttggaaaaagggacactcctgtttgtgtttcctctttaaattcatggtttagagttttctcctcttcctttcgcttgagcctccccaactgcagtgtctcctcagtcctctaactccatgactgtggatgaaactccatcttgtttttcttcaatgtgctatttctcaagtttacatctacaaatgtgctgcaaatatctggtactgaatgatgtttcatttcagtgaagcgtttgtttttgtttgttttgaaagttaattgtgcatgtggtttaaaaaatccaatataacaaaaggcatacagggacaccatttgaccatgccattccccaccccttcattcagttgtttcagcgaccacctttctttgttgtggcttgagaatccttccagagacgtgactaaacagccatggaaatgccagtgcaacagagcattctttacatcttgctttttccacttaataacataactttgaggttgtcctattttgacacatagacatccacctcattcttcaggaagcctctgtcacaggcacatatatggacctaccataattcattgattggactgccatggttggacacgaagattgtttccaaatacttgctaccataaaccctagtgcagtgaaacttccttcacacacctttttttttcttttttgagagggagtctagctatgtcacccaggctggagtgcagtggcacgatctcggctcactgcaagctccgcctcccgggttcacgccattcccctgcctcagcctcccgagtagctgggactacaggtgcccgccaccacacccggctaatttttttgtatttttagtagagacggggtttcgccgtggtagccaggatggtctccatctcctgaccttgtgatctgcctgccttggcctcccaaagtgctgggattacaggcatgagcccttcacacacctttgagtgggggtaggattccatatctattttaaatgtatatagatgttattgagttttagaggactaaacaatttagcttccaagcataacctataaatgcatcttggccactttcttgccaacagagtgtgttataaagcatgtcatttttgtctgtctcaggtcagtgaaactcctgtaaaggaccagatagtaaatgtgagccacatggtttctgtcctgactactcaaatctgcccttgcagtgtgagagcagcaatagatgatttgtccatgagtggtgtggctctcttccaataaatctgtatttacaaaaggaggtcctggccaggtttgcttcctggatcatagtttgctgacccctggtctatctaataacaacaataataatctttagtttgtttcttttgtatgagttaggctgttcatctgtttaaaaatctacttaggtatttttttcctgttaattacatccgttgctcattttgcataatgcagtttaactttctcttgttggtttattaaaagcaatctatatatttgaaacttaattacttttatatattctgaaaaataattgatctgttagctgttgcaacagttggctttctgataaatttctatttgacatagaaccaagtaaaaattatgttaccttgggttgtaacagttactcttaaaaacatttagatctgcaaggcacagtgtctcatgcctgtaatcccagcactcttgaagctcctggcttcaagagacatccccgcccccaccccgcccccgccccccaccttgtcttcccaaagtgttgggattatagttgtaaaccagcaggcctgaccttgtgtagacatggtaattgacaagaatcttgtagtcacattttcatagactatgcagtagatgcaatagactaacttctgtatgaatctttttcattttgtattaattataatcatttgccaagtttgcttcattcatttgtttagtaaaagagtatgtgtaaggaatttggtaggcaatttttagaacttttagtgacaactttgtttttgattgtttcttagtgaaagaaggattacaataagaacttagccacaaaatacaagtttccatgagtcactgcaaaataacagggatagtttggaaaggcaaggagtaaccagaagctttggggcatagttttccttagttaaatcagtataataaatggggtacacattgcaaattatttattcatagtttggtagtttgcattggtatgtcttaaacctgaatactttagagtgaatgaagtaaataggatgagatgatggggaatgcacacacacccacacacatgcacacacaaacacacatgcatgcatgcatacatacatgcacacacacatatacatatgtgtgtgtgcctgtgtgtgcacatgtgtgtgtatgtatgttacgtttacattatttctgcatattaaacactttcccctttcgttagatattctttattgagaaaatgcactacactagattaccattacttaaaagttgctctcgcagcacaaatcaattcattatctttaaggataagcccatgtctggaggtagggaaatcattttttaaaaattaaagtttctgtcttgaaatattgtcatccttcactttttctatgcactaggatgctctttgctttcaggaaaacacgttatgactcatttaatactgttgtccctcttatccagaacagaacataccgtggttgcctaacaggaaggctgcatataaaacccagttttgtctagtatcattttccccaagtccattatgtgtgttattgtgcagtgcatgtccaaatgaggatttgagcagtagagaagaaattcattaaagaaatgtgtcatctccttgcaaaaaggaaagtattgttgaggaaattgttactgataagacaaaagtggtgaatgaacatctaccatttgaaggcatttctctgaagtgaaaattaccttgaattgtcttgggatcagttgtgacttgatccttctattaggagctgtttcaaactcagagaaggggtgatgattcacactgatgactgaaggtttcttggagctggtgtgaataagaagggaaaagtattgcaaatgcatcattgtggctttcactgagactcagtggacagaattcatcatgatcttcctgggctccagaaacacaggcttgaaatttagtagccagtctgccaagcatggagttaggcacagatgggatctgagttagagaactctcctgggactggtacccagggagggtaatgtagggtgaaatgtcattgttcaacatgcttattattcacctgaacatgggtgacattcctttcctgagaaactctggtctgacaaatgggttcttacaattatttctgaaaatagaaaatgtatttccaataattattagttatatctatttattatttctagtcatattattcctaataattgagctctatggctattgggtgaggttcctcagggaacagcggattctctgttactgaaggagtttaaacagtatctataccgagagtagtcaagacatgcagagatgatttccatattataagagaagttggattgaattaagtctgtgattccctgccattctgagattttaaaagtccaggcctttaatgtaccaattccctgtcatcattagtctaattattggcaactacattgaattatacagtatagtatcagttgatgaatatagtatcaattgattggtacaacactgtatcaggttgaatttaactgagttaaggtatggccctaccttctaagagcttaccagttgacaataaaagcacatgggtaggcaagagacacccacattattagatataactatgttattcatgttacctaaagttggagagtaagaagaatgaatttcttgaggtagggatgaaagtatatccccattccaacagtttagatccagagaagaaaaaatgtttcagagaggagatatgattttaaaaattgcttcagaggaaaaattcagattggtaatggcagcctagaaagatgctaaatgaggaattctaagtcaaaggccttgcagaaagctaggaatgaacatgtcactggttctcatggaaaatgcttagagtcctgcagggaataaattcctttttttttctttttcttttattattatactttaagttctagggtacatgtgcacaacgtgcaggtttgttacatatgtatacatgtgccatgttggtgtgctgcacccattaactcgtcatttacattaggttatctccttttttttaaatcattattactattgtatttatttatttattttttattatacttttatgttttagggtacatgtgcacaatgtgcaggttagttacatatgtatacatgtgccattttggtgtgctgcacccagtaactcgtcaattaacattaggtatatctccaaatgctatccctcccccctccccccaccccacaacaggccccggtgtgtgatgttcccattcctgtgtccatgtgttctcactgttcaattcccacctatgagtgagaacatgcggtgtttggttgtttttccttgtgatagtttgctgagaatgatggtttccagcttcatccatgtccctacaaaggacacgaactcatcatttttatggctgcatagtattccatggtgtatatgtgccacattttcttaatccagtctatcattgttggacatttgggttggttccaagtctttgctattacgaatagtgacgcaataaacatacgtgtgcatgtgtctttatagcagcatgatttataatcctttgggtatatgatcagtagtgggatggctgggtcaaatggtatttctagttctagatccctgagaaatcgccacactgacttccacaatggttgaactagtttacagtcccgccaacagtgtaaaagcattcctatttctccacatcctctccagcacccgttgtttcctgactttttaatgattgccattctaactggtgtgacatggtatctcattgtggttttgatttgcatttctctggtggccagtgatgatgagcattttttcatgtgtcttttggctgcataaatgtcttcttttgagaagtgtctgttcatatcctttgcccactttttgatggggttgttttgttttttcttggaaatttgttggagttaattgtagattctggatgttagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccattttgaattaatttttgtgtaaggtgtaaggaagttgagactggtagaagactaagcttcttccagactttaatcattgttatctggaaaggaattgaaaatagtttttttctgaatcattgtaatcatgtgaaatcactaaatgtcagtgttgaattgaccacaaggaccaagctaattatggaagaaataggtgggggagacattgaacacagcaatccacaggagtttgagtaagtctggagtgttgaactggtgaaagtcctccctgcaacagctccatcggggcaattctgttaagtcaagactcaagcactggacggtgaatggtccagaaaaactatgtcattaaaaatgcacatttgtttaaaataactaactgctctttcgtggatgattggtactaagattttataaactgtttagggaccaccatgattcctcacacacattaattaattcatgagagttgattttcttttcaaacacattgatacattattagtagatagcaccccaacacacacacacacacacacacacacacacacacacacacacacacacacagagagagagagagagagaggggtacttacaatcaaagacagccatactagatccaattggtagcaacaaagtgagaaaagtaccagaacacacaggcaaattgaaaatacacaaagccacatccacagcatgccctttaatggaggaagtgggaagaaggttccattttccactctgctcattttcttccccaccacccattaagagtgtcaattctcattcacattccttttagagaagaacgaaccatcgaaaagggagctgagagttgtaataaaaatattgcattacggatttctccagtttcctttcagtatgaagtatttgttacttcattgaaaaaagtagaagtattgatcagccgcttagcttgtggcttctgctctcaaggagtcagcacatagtctgatgtggaggaaaatctataaatggatttctgcaatctgcaggtaagcatgggatgaaatgttccttgacatccaacccaggttagaaatcagttttcaagactctaaatttgaggacccctaggagctcaaatgataaagagaagaaggtttatagtccatgatgggggagggactgcacactacctgcagggtgagcagaaaggatgcaggggcttggtatcacaggaccagcattgtaaatattacaggaagtaacctttcctgtgtgtccttcatgtgcttttctttgtgcatattcttgaggcttaaaggaaagggagccagtctgtgtccatacttctctcccgtgcacatcatcccggcatggcactgctgatgcaaattaaaaaaataacctttgactagaagcattttcccagctaccagtttccttctccccagtgcaagacaatgtgacagcaaaggttcatgcacagaagcagaaaggtagtggaatgactcagcttctaactaaattccttccaccttccttagctttgtggtctcaggattttataagaggtctctcatgtgctgctacagaaccagcaggaaaaatcagacagggccaagacagagagaaaagagacacctttctcctatattgcccctacctagggctcctatccaaagcatgttctagttcctagatggttgattccaataaaataacataaaaataaactgtgcaataaaaatttaaagggagttgcgctgaccatcatttttgaaatatttaaaaatgagtcctcagtaaattttggtgtgaacattagtattttgtcatggatagaggcacaagaaaggagtaaatgtgagacctacattgcatccaatgcctgcatcagtagaatctaatctcttccccccatgataaaatggcctcattctgtcaactacaggctttgctagctttttctcagacaacagaccaaatttatccccagcctgataaggatctttattgcatttgctcccaccccacctactgtatttagggtaatggtgaaaaatgtacattgatgctgaattttatagaaatagtagaaatggaaatgatcttacagagttgtcatctactatctggtgtaggtttggttacaaagctgtatttcctcttccaagttttaagtaatcaagtttcaaaacaatctttcctgacatccagtttgtgttaaagccaatttcccaaatgattttcatttgcattctggaaatgcagtgaagccttgacattttacaaaatgacctatcttctactcaagtcaatgaaactacagtaaacattttatgtgtagttgcaatgcttgtatctccctcaagattaaacacagaaaagcatctttggggaggatatttaaatacgatattaaagcatataacatgtgtctgtattttttcagttttaagtatacttactaataataacaggcaaagtggtacgaggtaaaacactacttttcattgttcagtttacagtagtcattgactattctacatatgcgcttagcataatatttacagactatgtaatacaaatcacactctgtgaattctcatgtcctgtgagacacaggaacagaagagctttgtaaaaaaacagcaaagtacaacttgaaaagttaagccatatgagtaagaaatcaaagtgatgaatttactaagtgtttattaatatttaagctaagtttacacatgactcaacatcatattcatactcatagtctgttactgtactttgccaaactgtctgtactattttgtgagaggatattatctttaatattgctctcactgcaatgaagcataaataaagtatatgtcatgttctaccttttcaggagctccaatgaacacatgctatggtttttaatgactgtaaagaaaatttcaaagccatatcttatctgtttctatggagaagttgatcaatgatcaataccatttgcaaggaccccgatgtgtgacttgtttctctttatactgtgacatgtttccctgaaggtggaacgtcaatgagacattcattttctactaaatgaaaatgatgttaaagttgcagtctagtgataaagttaccaagatctgcttcttggattttttatggggtttgggcaacacataaagaaactttcctctcattcaagttgaacatatccaaccacttatatatatgttgcccagtgaggtcagtgttacatgaagttgtagaacatttactttgaaatgaggttttctcatttaataaaagtgtcaccttgtgtcagtggcttagctagttccagcttctattttatctcttatccaatgagaatatgcctatcacataaggagtgtggctgggaagaatggtggtctgtccttatctcctgggttctctggtttcagaacctgcacagcggacagttccaaacactgcattccaccatcatttcatcagcattcctcttggaataaatgtgtcttgacagtctctcttagaagtgctttctctgaagctactgaggaccatgccatgtgtaggcataactgaagcgtgcacattctatagagtgcctcgaagatgtgcacattctatagagtgcctccaaggttttcaagaagaatggagcccaacttggccacattggttacacacttgtgcatggtccatttattgactatcccaccttccaagtaatttacctgcacccgacttcttgtctcatgtggggcctttagagtaactccaaataagaccaggtggatgtgcagatgaaacgtttgatgcttgcatgtgcttgcctgattatgactgttaatcaccaggtgtgtcaaactactctagatgctcattgtgtgtgtatgacaggttttggtgctctttctgcttttgataagccattcaatttaatagggtgttctctgaatgcccagcttttctttaaacttagcatgtatattcactaccccacgatccacctaagacagttgcgtatcatttctttatgcctgttccgtgttctatgtatattagatgatttcatatagataaggagggaaagctcatattttatacattttaactattatgatgaaaaccttatctagaagaggttctcttctttttgaagttgcatagcattagtaaagctataggagctatctcttgtatctgactagaaacgatacacatttaagataaaaagcatgggccaggtggtggcatatgcctgtaatcccagtacttttggaggccaaggcaggaggatcatttgaggccaggagttcaagactagcttggaccacatagcaagccctccctccccaccctgtctctacaaaaagtgaaaaaattagccagtcatggtggcatgtgcctatagtcacagctgctcgagaggctaagttgggaggattgctggagtccaggagttcaaagatacgctgagctatgatcatgccactgcagttcagcctgggtgacagagtgagaccatgtttcagaaaacaagtgagtaaaataaaataaaaagcaataacaagattgcattatgctttgagggcattaattttcaaatttaactttacttgcatttttttcctgtcattctttctgtgtcggctagttcttattttagttgtaatctttttttagaatacttatgaatagaataaataccactgtattcacatagtatatttactattatttttgtctccttgcattgtattttaattatctatgtcagacactttcctcagtcaaatgtactactagccatctaaatggagaatttatcttaggaggagaattcttctcatttatttttgcatacccagcaaattattcgggagtgagtgcactgtttcatcctgttgatagtcttccctgaacatttataacccacccctgactggctccagtctttacaccttcctcaagacctaacttaaatacactgaactgcctgaagtcgtctttgaattttacatcctttctcttaactctcatacactttgcattgttttcccatacaggggcatcaagaaatagaccatattataatgaatgtacaataaagtactaagagtaataaaagtaaatatattccgaagcaggaaagagcaaatgcttgggttttttatagaaggagagaaacgataatttgagaatgtttcatggaaactcttgcatttgagcagaactttacaaattaggcttaggcttcaatagttaaaaattagtgaagagaacatctctgcaaagttgaatgttctggtctcctttctgtttgtttagtgagcagaattgataatcgacatgcaagtggcttttaaacttttccaaggaccagtcattggggaattagtgtggttcctctgaacctttctagtaatcccaggatttgagtattaagaacagttagttgtgttagccttaagatgaaattctcctaccttgttgttttgaagatgttacttagagggaaggagatgttttggtctgttcgggctgctaatacatctttttcttctcaaattttactttaagcagtcaggaggaaccaagccattccttcaacacttttcttagaaatagcttcagctaaatctacttttatcactcacacgatctgccttccacaaattactaaaacatgaacacagttcagccaagttctttgccactttgtagcaaagatcacctttctttcattgtgcaatggcatatttctcatttgcctctgacagctcataaaaatggagcttcctgtccatatttctagtgtcattctgttcaaaattgcatagattttccctaagatgattgaggctttctgtacagctcttctctttttttttctgagccctcccctcactagaatcaccttcaaaggtctattcatggcaacgtaggctgtgtctagcatacacttcaaaacttttctggcttctacttattacccagttccagagctgcttctgcatttttaggtatttgttatcttaacaccacactctcagtaccaatttctgtcttagtccactcagactgctataacaaaataccatagtctgggggtgggggtgggggggggtaataaacaacagacatttatttctcacagttctggaggctggaagcccaagatcaaggcagcagaagattcagtctctgttgacaacccacttcctggtccacagacagtgacttctccctgtgtcctcacatggaaaaagggtgagggagctctttgagatcttttcttgaaggacactaacctcattcacgagtactccatcctcatgatctaacaacctcttaaagatgccacctcctaataccatctcctgggggaagggagtttaggatttcaaggttgaattttgggagaatgccaacattcagcccataaaaggagatagtataggaaaactacagaaatcaataaactcttctactgttttgattaaaatatagcaagtgcatttttggtgtacatattttactttatctttgttattattcatctagaaaacaaacgtacatagtgatagttaattcttccatgacttttttgcaaaagtgttggtatgcattggctataagtctcctctctgacttcataagaccttggaaagctgccaaatatctcagaacttgttgtcttgagtcttaaagtgactaaaatgaccttagctctacctgccttataggatgctctgcccaatgatgcatgcagtatgcatgttctttaacagagtatgttttgagactgcaggtttaggcgttattagaatccatttgactccatagccctttttatggaaacatacatacatacttaatgtcaaatagtttatatctttttactagctaatatggataagtactgtctcttcccatttgactgtgtgtaactgccttctcttagaactcaacacaaaatgagctttatgattcacatttacagtaacatggagacagaaccacctcattcaaaacaggaaaaagcaggtataagatgccatgaagggaaatgagactgaatgtgttcaatttttctttgtttggcttatcacatatcgtagagagatgtcctcttacatgcagtagaaataagaacatccttgaaaactcggtttgagcagttcaaaatcatatattttttaatgttgtatgagtttcaggtgataaatcctcttcaggatacctcaggggttcgcaaaaatgtaaaaatatgtttaaagtttgaaatgactcacattttttagtatccacggcaaagaactgcttttccaaccttaataggatttcaaattgacattgacattttagtaaatcagaattagctttttctttttaagctcctgtgtcttatgtaaatggctgtgctgacttttatggaattgaatattccagaaaatgtcatggaacctaatataaaacaagttaacattctcatttttagatcttaaagggatatggtgttaaaatatagcttttgatacccatccaacctgtgcaaggttttctgtgtatatgcgaatttcaaatttgagaacttagcatgtcgatgaaggcaaatctatatacctgttgaaaacaaaattgaaattctgaaggaattattgtaatttacttaaataagaactgtaagaagtcagactgttaatggagtgtcaatagatttcttctgagagcttcaaaatcttttcactgcctttattacaagtctaccaaaatatctgttagattctgaaagccaatctctcattacaaaaagcattattcacaattttaacttatttccacaatgaacattctacagaattattgtatctttgtttaaagataaaaaattctccctcgggaggctgaggcaggagaatggcgtgaacccgggaaggcggagcttgcagtgagccgagatcgcgccactgcactccagcctgggcgacagagggagactccgtctcaaataaataaataaataaataaaaataaaataaagtaaataaataagtaaatgaataaataaattctccccccgaggtctgaaatttattattaatgtgaatattttaagcatttttagaagaaaataattttgtaaaaaatattgtaagttatggaaaatatggtggtgaagtataacattcacgaacttgctagaaccttgccctaaaaatgaactaattattggatcatatggcaaactgattaagaagaataaggaactactttatatcatgaaaaaatacatgactatccacctgccttcctaaaacttcttcctctcatgtgccgctattttacttagagttttctttcgggttaaggaacaatatctttagaaggctattcattaaagtactaattagaaaaggtagttaattaagcttgtcacacacaatttatatattttcttatgatgtgtaagagaaaacagcataaaaaagataaattatttattttcagtcaaaatagggcactttttttgctttcctgcagctcattatacctaaattcctttgtgaaagtatttaagtaagttctttgaaatattgcttttaaaatatgtttactctttaaagttttaaaaataaggaaatgtataatatagtgaaatttccccatcagtgtgttctgtgtattttctccagctctttcttgaattacaaacagcagttctacaactttaccacccacacacacacatttattcatttgcacatatttctttttagtgtttttttttttttgcaaaattggcatcatattaattatactactctgcaacttgctttatttactgtttttaatatggaaattgactgaagttaattttcaagcagttgtgtaatattgattgaacttaattgatatactataactgattaaactacctcactgttatttggaacacttatcgacaacactgcagtgtaaaaccctctttctacttttgcagctttatgataattctataaataatcagacaccgattgtgatgcaatcgtatcacaaattcaaagacacattataatgtcagtggaataagttagacatacagtgccaattaactcagggttccaggggtaattcttttcgtattgatgaaacgcaaatgcatcttactcattcagagttgccagggccctggtgtagaaatctaaatcataaccaaaacaaacagcatcaccacgaagaaatcaacaaaaacaatttcatgagggttttgagtatttgaataatatttcagtaattaaattttaaagcaagaactgacaggtttgcccaccccatccatcctgtgatgtcaaatgcacggtatgtatctggctgacagggaaattgaggtaggaaaatagaatagataatatgctattatgtacctgcgcttcagtttgaggaggataaaattgttttaaccttatgtccacattcctggagtggtttgctagacctgcatcagaaaatccacatcttagttcttcagctgttcacatctcaatccacacagccttttgtcattagcatgccagaaatgcactacattcatgaaaggaattactagttacatcatggtgaatgttagcatgaactctcattggcccataacattaaaatattcaaaacatacaaattggctaaaatcgtttagagaaaatgttcacaatggcatgatgaaggtataaaaatccagaaatgcctatgcctttgacctgctccagtgcccataacttgaagtctctttagtcctacgctcagccatggactaaggaaaatttctcattacctgatgctgactgagaaagataaaagaacaccacttgttttgtccttaaagacttgagaggcaaagagctacatgatagaagttgtacctctcacaagtttatggaaggagacatatgaactgttttctgtctgctgtggaagtcagatgaatgactgcctatatgtgtaacacatttgggcctgagacacacatgatgaggggaggaattacaaactatcactggtctccttctttttctgcgattactgttaccttacctaacagtaggtaactgtaatctaaaatgaacctaaaaattgtgcatgaacaaattagctcaggtagcttgcaacattgactttacagtttgacctaggggagccccacgggctgaacctaatgaaactcagccaggttatattaaaactgcgatagcctgtatctctacattttctgcaacctggtttctacatagggaaatgctgcttgtgtttgctgtaggcaaatcttaaataaaccatgactcagcaagaagaagagaatgatgtgcagagatattttagggaagggataagatggcagttttgaatgggagcccacatggtacaagtactcatattccattaccaacttcaggagctttttactttggaaaaccatttttcaccttatttcagtaatatgtcaagcatttcaggtggtctgcaaaagccacatagctcagaggcttagcaaacctcctcagacatcaggcagaaacactttctaaaccccttaatgagtgtcaagcaggaaattgtgagtatatagtattaaggagatggacttgctattcttaaatttacagaaaaaaattctggattttcttcctcagtctccacttaatgacagatttttttttaacaaaaagatgcatgacagtacctatttaaacttactctgataaatttgatgaaatattctttttttaatccagacatctctatgagtttcagaattattacccttgtcaaattcatctatgctttttttgtggaaatgttcaacttttgttctcactgctccctgccttcccccatcaacaaaccctgaatatctgggaatttctcaccagctattatttaactccattccacatgtccatcagatgtcctacacaagattggttaaatagaagtttgttcgctgggagaagatgacaactttttatattaaatgcataaaaattttctcaatactgcagggtgataaagacaaagaaaaggccaatttaaaaggaagtctttagaaaaaatacaataaagcagaaatgcttcactttcctacacaatagggaaaaaattttaatgcttttgcaaaaattaaactctaatgatggaacaaagtttattttatactgggtaaatttatgttaggcatgaaactacataaaaatatgtggacaacaaagagtgattcagggctgcttaatcgctgttgctcttggtgtggtttttaggggattgcataattggtgagttccttacacgttgatttctcagattcaccaggcaatacataccagctgtcttggtaaatgcatgaaatgttgcaatctttgcaagtcctgcaattttacttcaccagtaactttccctggtcaactaacagtatctagagatcaggcagagggtgaccaatggctgctctgacgtacacatggagatactgaaagatgtggagttaaggatatttgaataaatatttcatataatgacaactgtctttgttagcaagcagaaatatccactgtgatgcaaaggcatatccttatgtcatatatatttgctgtgaaaggtactgattcgtgcttatgtgaaaacctcttaaatcccgaatctggggtctcctctccccgttttttctggaactcagatgctaaagttgatacaggaggagtggactgtcccaaataaagcagtcggggaaaggaggatccattgcaaataaagggtaaaaaaggtacatatgaatagtatatctatttgcacgtaatgcaggttattctggagggtattaaatatctatcagtaactatcatttgttaaaaaccagggattcccaaggatgttagtggatgtatgagaaagagtttctggagatatatgtttgggtgtccactacgattgttgcatttcttttcttctttgtctctctctgtctctgactgtctctctctctcagtttgcttctctttccctttaaacacacacaaacacacacacacacacacacagacaccacacagaatattcccaacttcttaacacacaacaccaataaaaaatgccaataatcagattgtaaaactggcagttcttttctttcaatgtggctttctattctattgtctctcacatatcaaagaaacaagaggacaacagatcaggatacattttgtcatgtttacattatgtagtaacctgaaacaaatgcccagtgagtggagggtttcttagctttctgtcagttttcaaatgttttccctcctcctgcctccctggctttgggttggtgatgcacgtgctggtgctcagagatgccgtgcgccctgacaagagattttgaactggggcatagatgattgtccccaaagtgatctgctcagttcccataattctacacatttcaggcaatggaaacacaatgagagagatagtttgggtggtttttggattgcaaacttaggcagccacagtttcaaccagcaatactgatttttctcagcctttccatttctacccagtgcataacttatataaattttcttccaaaacttcacaattaaactattccttattttatgaagttatcaatgtgtgtatgtcttagaatataattggtgtcatacaaaccagtttatgcctctttaactttagtgctatgatcttaaaaattttgactcccaggcaaatatagatataaatataaatatacatgcatttttttcttgagagtcaaaattatatatttatatatatgtgtgtatattatatatatgtgtgtatatacacacatatagattaaatatatatatttcatattatatattacagattaaatatatattatctatatttaatttcattagtcatattgttttctacagtttgatttccagttttgcaggactttgtattcatattcctgatatcaggaaagggtgcatattgacactacagctcaggtggaatatttagaagacacatggttgtaattagttacttgcatttttcctgaatgctttttatggtgttgactgtttaagaatatcttgcattgctttccaaacaaatatactacacaagcagcatttcttgaatctcgttgatctgtgtggtgtgttggtgtggtcttatacaggattttgtcttttttttttttttagtgtggttgtttctccttttttcctttaatctaacaaatattgaagtactttaaaatttttaatactggtttttatggagaatgagagtttcctatcattttcctggggtaatgtcatacaatgcatttctgaaaaaaaaatacttcttaaattttgttaatgttctgattatttttctgtcattattttgccactttgtattatgttacattactattccataacctcctttgattccagcattgggaattggttttcatttccatggactcattactgaggtccttgtttctttcgagatattaaacctgaccctgaattttttttcttccctgtgagagtggaaattataattcttttctactggttcaggaaaaaaagaaactttactttctaaagaatatatttctttttatggtcagatacgttttaaataaaacgaaagctttcaatatctgtctgtaaaagagcagggtttggaattctcattggtgatggatatgtttattttcttacctgacacgtcagctactgcagctaaagccagtgaactatttctatatcacttactgatgaagaaataaagggctctctcatgatactaagtgtattgctgttccaccatccggatatttttggcttaaaccctgaggtgttaccagatggtaaggattttagaaatgctaaaatgataatagtagggactactttcgatattgtgaagtcagatatatcattgcaagttttaaaaaaatggaatattttatatttttaagtatctgatttaccttaataaacactttcatcaatttcaagagcatctacatgctacattctggtcctgaattttcatggttaaaataaagccccacccagagactagctaataactatggtgatcaacagtggacagaaattcagagatactagttatggtaacatcctttaatgctggagccttactgtcatagaaacatgtgaatgtcaaactaaaagtttaaaagccagatatttcaaaagagtggggagtgggagagtataaattacccccaaggaccctggaagtgctagattctgggcaagatccagatatttgcaatttgtttaactcccagttgaccatctgagaaatattgagcaagagagacagagagagagagagagagagagagagagagacagagacagagagagacagagacagagacagagacagagattgccagggaccaagggatgatgctagtgaaccatttagctacaaagtgtcaatgtatgaggctggcgtggtggctcatccctgtaatcccagcacttttgggaggtcgaggcaggaggattacttgagcccaggactttgagaccagcctgggcaacatagtgagacctcatctcttaaaaaaaaaaaaaaaaaaaaaaaaagttagccaagcatgctggtgcctgcctgtagtcccagctacttgagaggctgaggctggaggatcattgagtcctgcagttggaggctgaaatgagctgtgattgcaccactgcactccagcctgggtgacagaacaagaccctgtctctaaataaataaataagtactatgtatatgctgactctccagccttgcctagtccccagaagccttgcaaccttccaaaacttgattgtttttctcctaaatttctcagataattgaggggaaaatagagctcagaatttgacaacagctgtccacatctcctggaatccctggcagaatgctggtgctgtctcttctctgggtttcacagggcgggcataaattataactttattaggttgagcacatatggcctttagccccaggagaccctccatggggctagtctgttggcagaggcagcttctgcactttcattcaaattcacaatccataaggaaaaagaggccttcaaggctgcagcctgccttgggcttccgtggggcatctcctatcattgccaataatgctgtggtgaaacccaggccaaatattccaacatctttttgctgcttgtatgaacacgatgcatattgcagttcaaaactaggaaaaaagaagagcatattacaggcgaacacgaatgcatcagaatatggtacctttaaattaaaagagaaggctcttgattttgaattctcaagtgtttctcttcaaatacacacaatgatgtctttcactttaattttaactattatggatacataatagatgtatatatgtatggggcacatgcagtgttttcctacaggcatacaatgtgtaataatcaagttagggtaattggggcattcatcacctcaagtatttatcccttctctgtgttaagaacattccaaatccactctttagttattttaaaatatacaacagattatttttgactatagtcactctggtgtgctatcaaatagtagatttttttttcgaggcagggtcttgctttgttacccaggctggagtgcagttttgtgatgatagctcactgccgcctcaatctcctgggctcaagcaatcctcccacctcagcctcctgagtagctgaggccacaggcacatgctaccacagctggctaattattatttttttaattttgtgtagattaggtctcactgtgttgcccaggctggtctcaaactcccgagctcaaatgatccccctgccttgtcctcccacagtgcaacgattacaggtgtgaacctgtgcccggctgataggaatttttgatggagtttcccaatatctgggctttcaaagattttggatagtgaacgagatactgcaaagatctctctaaatatcaccagcctgaccagggaccttgtgttacctatatgaatacactgaggttgctgtctgtttctctgttaatgtataagcagagaaagttacattgatgctcatcagattttcagtttaatatcagagcattgcaaattaaaatataaggtgcgggacatgtacaattttactgcggggcatgcaaaacctgagggcccccaaagcagaagaaggcattcggcctctagtctgcatttcctccctcctgagttgccagccagccagccagcctgtcttacagattccagacttgccagctcccacattgcatgagccaattccttaaaatagatcaatttaataaatttaacctatattggtgaacaaatttagcagagaactttgatatacattagtaccacttattatttttagaaaaattggaattcgaataactaacactaaagtctaattcgtcatctggtgtgtatgttataaatgcacacccactcaccgagacctattcacagccacagcctcatataaaaataggcaatagatacaggaaatgagaagcagccatagagggtcttacgtaagaaaccccatccttctcacacctactcaagaacgttgttcccaacatctacatcttttgtagtttatatccactgggcgcacctaacatcacatccacattcttttgtttatcccgtttggaaatacgtgcctgaccttcactttctctgcctgatgtggctgcatgtttttgtttctctggcaaccatctcctcgtcttccaagagtcctcaccgatcacatctcaactcctctccacctatcctttcttaaattcactccaatcagtatatagcctcaccacttcaccagactcctcttgccaattataccattgcatcctaggccccacaaaagtggagttgctattcctaatgtttctaaaaaatggccattctgcattttccctcgaatctccactgcctctatttttggaaaagagtttcatctttgaaaaagcatttaagaccaacttttttcccactctggagggaaatgaaatattgctgaatgcagaggatatctccaaggcttcatactacttgctctggcaatatttccagatccttatcctgcagcatttgcggtagttgtccccctagaaatcatagttgaaacctactcctcaactgtgtaggtatttggaagtggggctttggaaggtatttggagagtggagcctcatgagtggaattcctaccattataaaagggaccccagagggcaccctcgtcccttttatcatgtgaggacacagcaagaaggcgctgtctatgacccagaaagtgggtcctcaccagccactgaatctgccatgccttgatcttggacttccggtctccagaactgtgagcaattttttttacaagccgtggggtctgcagtcttttgttttagcagccaaaagaggtaagatagggcatgttgggaaggaatggagatgtccacaaacaccctgaatcatatactgctccccaaccccccgtcctcccagcagagagagcaggaaagagaaggcttacttcctccaggttcgatgctcttctacacacagttatgacagacagattgccttatatttttattctttttagttcatctgaccaattgtcaaattgctcaaatgtcagaaaaatggctcaaagggccgctatggatttctgcagtagaaaaagaaaagacagaagactagatcccaatgtgttcctggactggaagaaagttcttattttatggagccataaataaatatgacatttcttgtgcctgagaatttgaggcaggtagtactcctgtgaagtaagataatgtcttctgtaaaagaataaattcattaaaaaccatgggaatcattgtaagtttcattgtcaagaaagaaacagacatgattttggatgtaggtgaatgttaattattgaagatgattattgttctcagaacaagtttattctgattcgtagccacagcagttcaagagaaaagcaataaaggaaccacaaccatatgacccttcttataatcatgttgtggtggggatgtttcttctccgtcctacttcctgagaatgacagaagggttttgcaagagtgaaggcagctgggaatatattccagccgcttccatagttcatgctgtggtaaggagtttcaaggtcacagtgaggcaaggagtttcaaggtcacagtgattgaacactagaacttgtgcctctgttctctgctgaacgtcttccatgactgctacatcagggcttggggttcccactgacgtggtgtttaagtaacatttagagtccttatggttatacactttcatctccttgtacagaaagtttctggaaactgcccactattatatgacacatattaacctgttgaatttggttatttatgtgaggaaaccacagaaaaccataacaaatcaaaatacctaagagccacaaatttcctccagtgcagccacatcccatagacaggtaatgtgcactacatgtgtaattttaagttttctagtagttgcattcaagagtgcccgaagaaaccattgataccaattttaaaaatacatttaatgtatcccaatatttataaagtactaagtcagcagacaatagagacaaaatatagtttgcatattttttactacatatttgatattcagagtacattttacacttacaacacatctcggtttgaacaagccacattttatgtgctcaatagccacatgtggttattggctagcattttggaaaacacagtgctagaaaatgcattcttcctgccatgatcaaccattgtctctcacttactcctgggcaactgtgttctaattgatttccgggcattgattattgcctttcagggagaacaactgatcaccgtattatagtaggtcattcctacacatggccttcaggtcccaaacccgtctgatttgctaagccgtttttccctcttgtcatgccatcttcccttcatttgctacattccaggttttctagtctaatgcagtcactccaggcactctgtacttgtactcagcatttactgggtggtgtatatctgtcgtaggctgttggttgtaagtttcatgacagcatacactatgcctccctttttccacatgcaccaatccatcaaacctcattgaggacataaaacacagcatataaagcactccatcgattgaattgaattaatgtgtgaacaattgcacctgcaagtgtaactgagggctcacgtggttgtcatgtatcatttttaaaatgtttaaataatgcgagttttcatctatattcttattacttctgtagaaattaatctataatatttcaacagtaacatggttgaaattgaggccttatgtaatgtttgaacacaaatgataacttgattctgaatcaacactgtatgtgcgatttgatgtctgatgtatgatttggggcagtttgagggtcagtcatttatttgtactgagcctctcaaattccctgtatgtgaagggaacagttgagaataagtgtcttcagtggataagacagtcgtctttatccctggaaggcatcaccaactgatcacagcagtctgtttttctgagtcaagaggcaacttcccctctatgtaggatactacttttagtgtagtgtgctcttccatatctattggaatcattacacctgatcaatcaggtttaagataaagggtgtgatagatagaaatggatgcagatgctcttgcaaattgagttgaaccctttgtctttgcatcttgtgctggcctcagtgactgtcttcttgaatagaatgttctgggagtaaagcactgggacttccagggctggatcataagaagctattaagcttccatttagggcacttggagtactgaccctcagggcattctctcttggaaaccacatctcatgttgcaaagtgttcaagccccatggagaggctatgcatggtgctccagtcagtagctttagcttcactcccggttgacaaccattagtaccgccatgtgagtcacccattgtggacatcccagctgattgaggactcctgtctcttcctatcccttagctgactaaggagatctcaagagagaacttctcagctaagcccagtcagctcacagaatcatgggagatcctcataaaaggttgtttgaagccccacattatgggcatgtttgttacacaacattagctaaccagagcaggcactgaaactggaagtgaggttctgtttcaacagaaacctaaagtacatggtgttggtgttggaccctccatagggcaagactaaaggcttgaagaacaagggaagaaaattggaggctggggaaatggaatggacaaagagaactctttgaatgactcactcacagccttacaggacgagaagtaacttttagcactgtgcaactgcaagcaaactggattttgtcctttaaaatagaaagatggcatctcaaagaacacatttgtcatgagtagttcctaataagcataatacttaacataaagttcactggcgtatgttatttataatcttactatagtataatttccattggatagcaaaaggtcaaggatataattacagaaatatattcttttaaaatttcttttggttacacttaaatgtaaattgtgaacaccattttattttctattgtatcccatgacttttctattgtttgggtcatattaaatctatttttacagtataaattttgcagcatatattcccacaggaaagaacaaattataaaacacacagtttgtatatgtctttcctttaaaagtgaaattttaactagtttttcttttttttctgttactatgtctttccattctttggttcaatacattcccacctactcttgaacgttttttggaaagttggcaatgaccctttaaattcttttcagtctctatctgcctaacatatatttaggttccgtatatatttatatcatttcctacttaaatacacatatttccatttttgtgctcatgctattctgcaaatgcctgcattttaaggatgagacatacatttaaaaagggcatctatgccttctttcagaattttttttctaaatatctattactttgatatttgaaattttgtacccacaaacatacacatacacccatgtgtgcataatatacatctcacagaaatgccagccatgtcgggaaaatgacagctccatcagaaatgtctttacatccacgtaatatatcttatttccttgtataaggcacagatcctctgttaccaatatcaacttatccccaggctctaaatcacttgaagctacttttgattctctggagaatttcagaatatatttttttcctcaaaatttcatgaacttgtatgcattttgtgcctcagactttgaacgccttggacaaattcctttatccctgtgaatttttaacgaattctaaacaaaatacctgactccactttccccccaaatttcctgaccttgcgtgcattttgaactgcagacttgaaaacacttgtgcaaacgttccttcatccctatgaatctttaatcctaaacaaaatgcctgtatcaatgctggcaaggttgtggagaaaagggaatccttatacactattggtggaagtgtaaattggttcagccattgtggaaagcagtgtggccattccgtaaaaagctaaaagcagaactaccattagacccagcaatcccatccattactgggtatatactcaaaggattataagttgttccatcataaagacacatgcgcacatatgttcattgtagcactattcacaatagcaaagacacagagtcaacttaaatgtccctcagtggtagactggataaagaaaatgtggtacatatacagaatggaaaactatgcagccataaaaaagagcaagatcatgtcttttgcaggaacatgaatagagctggaggccattatgcttaaccaactatgtcggtaacagagaatcaaatactgcatgttctcacttataagtgggagctaaagatgagaacacatgatcacatagtagggaacaacagacactggggcctgctggagggtggagggtaggagagggagaggatcaggaaaaataactattgagtacttggcttagtacctgggtcatgaaataatctgtacaacaaacccccatgacactagtttacctgcataacaaacctgcacatgcacccctgaacctaaaataaaagttttaaagaatgccagtatccactacatttatgggcggtctttctgagtttcacctcagagaaacactcctaaaattcaagttatgactatttagactatttgttaatgatagctctgtgtgtgtgtcttagccccctctctgtttcctatgtgttctacttgatttttaaataaactataggagctccacatactaatttgattctctacataaaatggtgccatattctcttatttttcctttaggatttgtacagagactgtacaaaatattttttgagttgtgtaatggtatccaatatggacaataaatgataagtaaattttggaaaaatcagttaaaagaagtgtaatagatacataggtgtcttaattgttttccgtcctcaagtatggacgtttttgcaaagacacgagctttttacttcaggagacatttgtcgacgtctggaaaaaattttggttgccacagctagatcatgggggtgggtatcacttgcatctagaggacagaggccagggatgcttttaagggacccacaaggcacagaacagccccccatgacaaagagtctttcatctacatgtgtcaatatcgatgagattgagcaacccaggtatagagtaatactgatgagcacaaagtatagcttgaagcctctttttccatatggctgtgatagattgttttaaatgatcattggaagaaataaacccttggttctatggaagtcatgaggaatattctgcccatgtgcttgtgaaacctcagcttggagcaaagaggcgaatatcatgcaagtggcttcctagaatcatggggttttgtacagattatttcatcatccaggtattgagccaagtacgcattagttatttttttgatcctctccctacccccacccttcaccctcaagtaggccccagtgtgtgttgttcccctctatgtgtgcatgtgttctcatactttagcttccgtttataagagaggacacgcagtatttggttttctgagctggaggccattatccttagaatcttctatgttaaaaacaacagagcacctcctggctttcctgggaatccttgtttcctgattccagacaagcgccatggctgtgaaatcatgtatttatgtgtatgctgttggattttaatgtgaaataccttttcactgcgccaagttcgcttccaaatgtgatcccgccaggctgaccaacaaggcattcagtcagcctactttcttatgccgggacctttcacaaaatgaatcatatgtcacttttcttttcagaagcatatgccattttattttattctgggagtttgaatcacaccatgcatctgttttagtgttgtttttagtaagttcactatcagtgcttcctgagcatggtttctcgtatggggtactcactgacctgtcccatccatcttttcttcctataaagcctttactgctatacttgtctacttgcagaacctccacactttttatgagctcccatttttctctcttcttggtatttatcattacttattgtgactcttgcatattggatggtcaaaagagatccccagtggttacactacaacaagataaatgtaggtatacttttcttaattgttattagtgttacttattattttgttttattagacactactttcaaaggctttacagcactgggtatgtgttctacctttttctttcattttatcctccacaacagttctgtgatgaaagtactattattaacttcatagtttacacgacaaagcatggtttcataacttgtcaggatttcttagccattatttgataaaattagggatctaaattctgtcttctagctccaaacagatggttctttccatgctatttgctattatcttgtcaaaagtaatgacaaaatagaactcaaatagtatttttcttttggctgatttcttctttcagaccagagaggtttccaaggttaaagtagttcattaatttcaatttcttcttctttttttttttttttttttttttgagacagagtcttctggttcttttgcccaggttgaagcacagtgacaccatcatagcacactgcagccttggcctcctaggctcaagcagtcctcctctcttggcctcccaaagtgctggaatacaggggtatgccaccatgtcaggctactttttatttttatttttttaagagacagtcttgatctgttgcccatgctggtctcgaactcctgggcttgaacattcctccctccttgacttcccaaagtgctgagattacagacatgggccaccatgcctggccttaatttgggtatcttctaattgatgtggactcttatgccctattcatttgtgttttgaagtgaactgactctgaatgtcagtgatagggcactgcttagtgttgggggtggttaggaagatatgcaagtttcttagagaataaagcagcttgctgttcacagcagagggggtgtaactgtttcaagaattttagaatactactgtctgtgagttctgcaagaagttagggaagcctcccactcctggttagactggcagcaactttttgcattataacacaacagacatttcatgtccaagccaggtaatctgagctacccttgttcattccagatccagggttggtgaggcaaaaagggtgtccccaaaatagatgggtctctttattgaacttctgggttatctccatcatgtacagagatacagaatcatgcatttataaactttatggttgaagatggcacccacagttacagtttcctcccaaacctccctggcctatctcagttcttaaagatgtctggggattcccagttaggcatagagtaacaaggcagctctatccttaaatgatcatggcaagctgccatatggctggtattcatcctcagttaatgtggatattctagtaggagggcacagtgacataggaagaaatggtcactctgtgttcaaattattcctttaacttagaaggcaagtttaccaccctgtgggtactgagcattgcagacttcatgtaagcatatttttgagcattttctacaaaccctcatttctccaaatcccatcctttgcaacctcaagtttatccaggggattcacactgcctgcatgtccttgtatgcgtttcttattgttcctgtaacaaattatccaacctgtagtggcttaaaacacacgcatttgttatctcaccattctgaagctctgaagtgtgagtagctcggatggtttctcttcatcatcacccaagggtgatttctgtgtgttggcagaaaggctgtgtttcttcctccagactccagggatgcatccacttccaggaacatttgggttgatggctacatccagttccatggggttgaggttcctgcttccttgcaggctattggctgagggcaaattttggcttcttgagaaccgtagcattccttgactcctggcctccttcctcccccttcaaagccagcagtggcagcttctaatgcactgaatctctccgacttccttttctacctcttgtctcctttcccaagttgcatggcttgtctggactgattgttccattaccattttcctgcttctcagtatcatggacccacttggatattctaggataatcagcttatcttgacatcagctgcctagtaaccttaattatatctgcaaagacaattcacaacagtacctagattcatgtttgatttaataaccaggggaacgagaatcttgggtggatgactttataattctgcttaccacattcctgtctataaactaatcttaaggttggtggacaggccccttacaactgactttgagtacccagaacactggcttcctatctttactcaaccagtgggctcctccaggaaaagcccaatcaaggaagataacgccattattctcatgcttttcctttccccttccctccccttctctcccctcccctcttctcccctttcctttccttctctttcattttgagacagagtctttctctgtctcccaggcaggagtgcagtggcatgatctcggcccaatgcaacctctgcctcagcttcccgagtagctgagactacaggaccatgccaccacaccacctaatttttctatttttagtagagacgaggtttcgccatgttggccaggctggtctaacctcaggtgatccacctgcctcagcctcccaaagtgctgggattccaggcatgaatcaccatgcccagcatgtcatgccctttcgaagtctgggtaataatcctcagatggtagtgcacatagttatggagaattagtgaaccactcctccctgatgtggctcgcccccactgcaaataatttgtctatttttatttttatttttatttatttattcttttttgagacagggtcttactctgtcgcccagtcttgaatgcagtggtgcaatcatagcccactgcagcctctacctcccaggctcacgtgatcctcccacctcagcctcccgagtagctgggactacaggtgcatgtcacctcgcatgactaatttttaaattttttgttgacgcaggatgttgttatgctgcccaggctggtcttaaacttttaggctcaagcagttctcccacctaagcctcccaaagtgctgaaattaacaggtgtgagccacccagcctggcctatttgtcctttttaatttaaaagactcaacatgtagaaaccattttaccccttcaccttgtgcattaagagcttcctttttcttaacatcctgctccttgaaatcaacccactctacttgtatggcagttgttattttaatatttctaattaagatacagttttcattttaccttacagagacagtgagcgggtgctcttgaattccagtctggctttctccattcctttgggtaatcacaggttaacttttttccttcatcagttttcagcagtcagtgaaaggtgcattcattttcataaatcagccatttggcaacatttgaatgtttaatcagtttgcgatcacatcaaagaacaagggaagttcttgggagatttattacctcctttggaatctgtgttcttagctacaaaggtgcaatgactttttctagttctctgccccagatgtctgaactgttaatatttacagtgctcctttcctgaaattcagagtcagcacctcattttatcctatttgtatcccaacttactttattcaaagagattttacaacctgagatagctccgtaggaagagttcagttgtcagaagcaatctgatccatggaaattttctggtgtttgtttttccttgaattaatttgcaggtttaaattcttgcttaggccactctaggacttttaattgctatttcttaggaaatattccttagaacatgaagcagtctgtctttcaacacacacacacacacacacacacacacacacacacacacacacacacacaccccctagcatacgatccagaacaacgttttatcttttttttttttttttgtaggagggagtgtctcactctgtcacccacgctggagtgcagtggtgccctcatagctcactgcagcctcgacctcctgaacccaagtgatcctccagcctcagcttcccaagtagctgggactagaggcacacaccatcacacccagctaatttaattttgaaaaaacttttttttttgtggagacaaggtctccatgttgctttggttggtcttgaattcctgggctcaagtgattcttctgcttcagcctcccaaagtgctgagatttctggcgtgagccaccacacccagccctaacattttattcttttactgactgtgagattttcattgacttacgctatgtcaggcagacttttcaagccataacctggctttggtgatttattattttagctcttcatgttttaacagcttctctgctaccatgataggttataataagtgatagaagaaaggcattttaaagtaatttatgaatgtggatctcattttgcttagctaaaaaaaaaaaagttttttttttttctagagaatagaaccaaacagtgttcactgtatcacatattccttttagtgtattgagcattaatggggtatttttgcagcatcagatcttcacaaggctggggttcatcagcagcacagtagctattaggtgattttactcaaggcagcaaaattcgtttcttataacacagtctctattgaagacacactctaaggcagtttgcctcatctatttagctttccaaaattctctcttaaattgcagtttaatgaatagactaaaacacaaattttaagaaaaatgtagttataagatatgaagtgtcttttaaatctgccagtggtttaagggatagtatacatttaaaataaagttataggcactgatttagtcctggaaaataatggctttatttcaataagccagtatcagaaattagtttttgttttctttttttttttccgtgatgaaatgtggtttctagtactggataagaaatgcatgagaaataatgtatcccagcatatttaatatgcaacagtgtgatctcagtagccttgcagatggctgagctgaggcactaaaagtgatgagatgacattttgtatttttccacacgttcttgcccattctcaggtgagtctgggctctcatcagtatttaaatgctgttttaccttggcaagacatttaggtccagaaaatagtttaaaaaattaacatctacgcagaaagaacctccaggtagttaaaaatagggcaatttgcggatacaccacatcctgaagacttagtgttgctaagtaaaccacattattttaggtgtttcttcctgacatttttatttttttcttgtgttattttaattctggaacataactgggaactgagaatactacatgggacccttatctcttttctttgttatgactgaaaatcataatttgaaagatgcttggaaaagggaaagcttaatatcttacacatatttttataagacaaaaatatggaaagatatgaaccataaaatcagtttagaatgggaagggttagtaaaacattttttttgagcagaaaaggaatcatggaatggacactttataatatagtaattcagccaatttatttgatggaattcaaatgtcatgtcctctttgtagctaagagtgcacattagcattaaccctaaaccagaccacttggagccaaagagatgtgtatgtgtgtgtgtgcatctgcttctgtgtgtgtgtgtttgccccatctgagtgatttgatttttcaccatctctctatttttccacttccaaaatttaagcatttagacatttattatattaaatatgtttgcattctccctccctccacatgcagtgttttacaaatttcctatcagactgttcccatcctgcaaacccccagagctctatggctgaggtactcctctttctgttcccttctccatgcagatggaatgtctgctgggaactatcttcaatctatatgtttcccattcgtagaggtggctaaatctgtgacatgcatccatcctcatccaatagtgtctccacatgagtgagctggataatgcaaaaccaagcttcgacatcagtggtatgaagtacacacacacacacacacacacacacacgcacacacacaaatacaaacacacataatctctgtagctcagattgggattgtctagggttaatatcttttgtgctaaaaatatccctgtgccacattgaagcttattataataattattaattactgatatatttcaactgttatgtctcctaaaaatatgcatagattattaagttttcccttctccttgtgtttttctgattatgattttctatcataaaggtgaaagtgataagggtcccatgtagtgttctaactctaaacctaatactgaccctaaacagaattgaacgctttaaactaacccatggcctttgaccattgcttcttgaccgttgagttaacccataaccctgaacagagaatgagaaattgaacccaaatttgaacccaaaccctaactagtgactggatatgaaacctaatcctacccaactttgaaaaagaactcaattctaaactcaaaagcaaagccaaccgaacacctaatctaactttaatgtaaacctttgaacttacccttaacttttgccagtagcccttgactcttgacccctgatctgaacactgaaggcatcccccaaattctccgacccatggcctttgatcctaatcttgacttttgatcactgtccctaataatgaatataatcccttgatcataacattgaactttgctcctaccctgacattcaattagtgatctaaccataccacaacctgaacttgaacccaaatcctaacatgaaccttcctccatacctgaaagctatcctaacccttgacctttgatctttatttttctccttgactcctgactgtgagatcccagcctggactaaaatgtatacacacactcaaaatcttttttgttctgaatcgttacccaaacctgaacttgaacccaaaccctgaccctacccaattacaaatctgaatacaaaacctatccctattctaaagttggggatttgagtctcttagtcccgtagggtagatgtggtgtttgcagccctgcagccactatggacaccacagacttggacaaaatctccaacgtatttttgggaaaaaaggatgcaaccattagagaacaagatgttgaaactttcatccataatctctgtttgtacagacttcagggtgaaatacatgtggttggaattgtgatatttccagccacaaaattgtattatgttgagataatgtgggtttccctatccctgaaaatgtgttcatccaaccaatagttacttgtaccagcagtgcaccagggaccattttgggttcctggaggcagccgtaagcaaaagcatcccagatccctgcttctggaatccctgactatggaattggcatcctcataatgaatgtaataaagaaataaggtaaataaagaaataatctagactcaaatgtgaactttagtcgctctggaagtccaaaccctgtccaaacatgtccgccgattactttcagaggatgggtgatgactcaggttaatatggttatttttggagcccgtcttacctattgtcctttatagatgatgtgttttccacctcagatatcaacatgaaagactgggtcacttctcaattcagaaatccactcaaggttaggcactttgggaggtcgaagtgggaggatcgcttgagcccaggtgttcaagaccagcctggccaaatggttaaatcctgtctctacaaaaaatagaaaaaaattagctgggtgtggtaccacctgcctgtagtcctggctgcttgggaggctgaggctggaggatacctgatcccaggagtttgaggctgcagtgagctgtgatcatgccactacactccagcctgggcaacagagtgagaccctgcttaaaaaaaaaattcattcaactatgtgtaagagagagagagaggtgtttattagatttaactgaggatttggggagaaacttgggggcattttatcctatgggataagagggaaaaataaaccttttaaattaaacatctcgcccttttgctgactaccttttggctatcctaacatgaaatattcttctggatgctacaactctcagctccactgatcggctagagcagattcaccatcacttcttgtttttggatttcaccctctgccactcgtgatttaacaaataattctctgaaaggcagttctcttttgaaaaagagttttgcttctctgtgttaaaataatgtgtgctgctgttaaaatagttttgtatacacgagggaactcctttagaagctttatcacgtctcttagctgtgcgtgcaatttgagtaattactatgtaccaattccagtaacatagccaatacatcagaactctcaggggacgtagctgggaactttcttgcaaaacaactcccacgtgttcattcctgtctggaaaccaccagtaaaatttataatcagtaataatttctccaggcacagcaactgagaatggtagaacattagttttaaaaaccattttaataaaatgcctttataaatattgagacttaattatttagattaatttgttccagttaatgaaagatctcttagcacaagactgggaaaaattagaacacgtataattttcttcattccagataaacaattattttaatgtttatctggtatttgaccacaaacttaaattcctgggtttcgtaggattagaaattttaaggttagtaatcactcccgttgttaaactgctggattttacctaaaattactgcaaggatgtatcatttttttatacctcaagctgttttgtgcagttctgcttccaacttccatagacaattttaatcatttatttttgttttttcttatcagataatgtttcataacatggatgtgaagaattaaatgaacatccttctgtgcacaaattaagattagaacacgaagattttgggattcccctcagttccttttataaattgtatttctttggacctgtcctaaggataaccacttttgtgaatctgattcattatttccttcttttattaagttttatttctgcaaaattgtcatgaccagcataacccaaagaatatattgttcgctctgcttttgatcttttataaataggatcatcctatgttcttcttgacctggcatttcccttttcattgaatagtatgtttttgattttaaccatgaagatgcttggagctgtagtttatttgtgttcactgatatatggaacctcacccgatggttataccacaagatatttaactctttcagaagctggaaatttgaattggccttatgtaaagagttcagctattaggattctgtgcgtgtctcttgttgaaaaaaaatgcagaagtttctccaactagaaatgtatttactggaccatattttatgtgcatatttggatatacactctcaggttaaaaactgtttaagtggttggacagttttattcacccaagaacagtatcagagttccctgtcctctctgcattcactgcactgaatccaaaattgaatagaaatgaaattagctgtctttgatttgttctctctttagacaaaaggcttccaatgttgtatcattatgtataatgtttgaagtaagatataaataaactaccattttcagataaagaaatgtttatttctttccttaatttgataacatacaatcataaattggttcaaggcatttttctttatcttgtaagattatccttgctttgcatttaattttttcatgtagcaaattaaataacttaactttcaaatgttaaacttagcttgatattcagtatcttctttaatactgtttttgtatttgttgttagatattaatcatttttttctatctctgtacaaaacaagatagactataatttttctttgttgagcttccctggttttagcatcgactaatagtagctgtgtagaaagagtaagagaacatttgtttatgctttctgggagagttcatataaaaacacaaattattcattcattaataggtggtagacttgccattcagtccaccttggacagattatttctttgttgtacttaaaaccatcatttatttcctccttgatttgtggactacattacatattgacttcttgtatatatgaagaaaaacatgtttgtatgtctgcacatgtctgttatcactctattatgttccctttctgcatttgtctgtctgctatatacattttgctaaactgtcataacaaattatgagaaatttagcagcataaacgaatagccatttattacatcagggatctgtaggtcagaaatcctggtgcagtggagcctagcttggtcctcttcttagggtctcccatggctgaaatcaagagattggcagggctgcattcctttctgggtgctgtagggatgaatatatcacaacatatagatttttaaaatctaattatttgcactaacttctgattttaccacattagattcatagggtgaattcctgtcatattgatcattcgagtcttatggaagctttctttctatcttacaacatcgtcagattgttacaggttttcatatgtatttattcttatgctttaaacaaggggttttctctgttttatgtaaagtttgacctaatattttcatcatatctgtgttatacttgagatgtatattgtgaatatataagcacacacaatgaactattcttcagccttaaaaaagaaggaaataagaaggaattcatgtaatttgtgacaagatggatgtacctggaggacattatgttaagtgaaataagccaggcacagaaaggtaaacactgcatgatctcaattatatgtggaatctaaagaagtcaaactcagagaaacagagagtagactcatggttgtcagggactggaagttgggttcatgggggaattttggtcaagaggcatagacatctttcttcttcttataatattatgttcctatgttctagtttttgagctattaggatttccatatcagcattttaggtcttatttatgcttgcattttttatattcttgataattttagtctttctatatcttttgggtttaaatttgtctcttgagttggatgcattcttcatcttaggttttgttacaaacatgagattgtctggaaatttttttaaattcatgagtttaaaccatttatgtttgttgaacgttaattttaccgatgcttatttctgccatcttgttttatatgttcaatttagttacttcaggataagcgtaactgtacattttgtttttgaaaacataagtttctacctgtcatttaatagatatttaaatacatagttatttaaaactctgttatctattttttatccttactatggttaaccataactgatcacagggaatgctgtttatttttcccagttgtttttataaatttaacaacataatattggtttataccaattttgttcaatttctatatgaaaatcaaaaatatatagaatacatcaaggaattcattgacagatctgggaatttctaacaagataaacttttttcaaacatgcatcttttttagtcccacccctagtgctatttaagtagatatttccaagaatttaagttctgggctattatccatatatgatttttgtcttcctttttctacccattttagccaaatagaaattatagttattggttgtgcttgcatttcatatatttttcagaattcttaccaaattagttatattctttgataagtattttctcaaagataattttcagtctttaaatctttgcttagcaaaatgattgaatctctttttgatctttttttttaacttggcctatagtattaaatttttttaaattcagagttatttttcttcaaactttcaaatatgactcctgtgtctgctaatgtcttgtgctatgactgggaagtttgatgtcaatctgattcctattcattcatagctcacccatttttctctctgaaggctattagaattttctgtttgtctttgatgttcttaaatttcttagtaatatatctattcagggcactctttgagcccattcaaaataaggtttttgttctttttgtttgtttcaagtgtattttcattctttcatcaacttagttcttcctctgtatttttttttctctttctgttacctgatcctggtatctctaacaaagtcatccatttttccaaggatgcctttctctcctttattctttcctgatgctttctgggaatttcttccatctgatcttccaatttggtaattcattctatgatttatcttaactattaggttcttgttcatctttactattatttattctatacctactatatttaccaagttctcttttacttcttattataatctcctatttgaaatatattcccttaggtgatcgaatatatttattttgtctattgtaatttcttcattgatctgttccaatcattatatttaacgtagaagaatttttttttctgttgagagagagcgtttggtacctttgtaaatgttcaggtatatagctctttgttaaacatttagcctgtgttctccttaggtgagtggaaactcatccatcactctggtttgtaattacgcatgtgatgggacctaagggcagacccaagtctatgtttcttctatgagattaacattcaacaaacacttttagatcactctggcgcactgaagaagtttgaaatttgagatttggctttaaactctctaaaggagccagcattaggaagaaacagcctctttagcttcattcctgggggtgtggaggggaagggggtgaaacaggaaaagcccatagtggccataagtgactggtggccctgaaagtttttaaccagctcctcaacgcagctgagttttccgtgggcttgccagagtcccactacctgatggctgccctcgagttctaagttgtatggagaagagacgatgggagggagattagacaatgattaactcaaggcattctttataagagacaagagtgaacttaatactttgtttttaaaccagcatctttctattaccacttccaccctctgccagaaggtgcagccactcccattcaccatatatacatgattcatcagcttgtaatctcctcgggatggcttatagcttactgatttcatgttctattattgctctttccgcagattgatgcctcgtcttatcctctgtagtttttcaaaagtagatttctgtggaggaaggggcattatgttctattcaccatctcaaaagaagcataactctctttcttggatatattactatttttcccacgttgtgtatgcttctcattaaaggtaggattctaaaccatccaaatgaatctgtgccaccacctgcccctggactttggactgaagaggattgagaaatggtgaaatacttaactatttgatagcttccttcattcccacagaccacatcagatgtagttagctaatataccaattaacaaaattacccaggaaatgcaacatatatacttatttcattacttgtcaaaactttctaaatggctttcatctatttctaaaaagaatcccaaatgttccaggaacaatttcctaatgttctggttttgaatatcacagctcatttatcagcgtatatcatagctatgactatagacgccaaaatattaagtaattcataatgacaatttggacaatgaagggtatattagaacttctttgagtattttttattgcaatatgaatttttaaccaaagacttgtatgagctccagagagcaaatccactacatttccccactctgcctcccaacccatcactatatagatccattgtggagcttttttacttctttgtggtgtattaaaacaaaggatataatatcccctgattatggatgaaagtgatggaacatttactgccatgagagtcccttatgataagtggtagctgaactggaagtttaaagaactgtggcagacaggatggggtaaatcaataggatccaggacctaggaatgcatcaggaaagacagcaacagggaaggatgagctagagcaattgaaagggtgatacatatatttggagccaattctttttatgctatcatcaagataaaaccagtattcctcacctggtagatatttctctttgcaaaggtggatattccacagttcacttccacagacctcatgcaaatgtcagattcagcggggagagggagcaccccagtttctttggcagcacagaatataatgcatcatgtttatttgcaagcctggagatattcttgcatacatattttatctagcagatgacactggatccaattaattggtggctttgaaatatatttattggaattcattattttgggttatagttgtttctgtgatccatgcaatctaccaggatactcttcatgcttttgcatttaaaagaatgacaccaagggcttgtgaaaggcacattctggggtccatcccccacaatttgtgttctgttgctttaggggagggtgtgaggatttgtgcatctacctgctttccacaaagtagggtccctgctggtataagggcacaccgtttaagtgctactgcacagaagcatcagatgtcattaagattgtgtgttatctacatttcttattgttgctcaactgccagttactcttttcataaaatatgtatctgtcctatatagggctaagaattaatttatcccagtctataactacagagagaagcctacttaatgagcattcttgatggggcataccacccataaatatggcaccttagcatttgaaaaaacagaagaagcaggaaagttctctctgaccttctccccatccttctcccctaaagccaggtcataagaccctcctatgagaggtgactctctataccaagaggaatagaacattcttatctctgaggacaaaaggacacagaggagaatctgaacacacaggccttgctaagttctccccagttttttcccattagataataaacatttttacttcaatcatactttccaatgactgtccactctttatcaaacctaagtatctaagcacaaaaatccacaggtttccctgtttcttttgggtcttcattgccttatgaaggctcctgtgtcatataaaactgttattaaatgaagtgcactctttgcttaatctgtcttttgtcataggggcctcagccatgaaactaagataggaagaaaagatatttcttttcccttatattattcaacaatattctagttatacatgtaagcttaaccaaaagcttctagaatatcaaagtaataagtgtgaaatatgtgtgtgtgcacacatgtgtgcatgcatatatatacacacactacattgtaggtgtgtatatatatgtatatacatatacacatatatattttataagatgcgtatacacatatacatttttgtatgtgtgtgtgtgtgacagagtcttgctctgttgtccaggctggactgcagtggcgctcactgcaacctccacctcctgggttcaagtgattctcctgtctcagcctctggagtagctgagattacagccatgtgccaccatgcccggctaatttttgtattttcttttagtagagatggggtttcaccatgttggccaggctggtctcgaactcctgacctcaggtgatcttcccacctcggcctcccaaagtgctgggattacagaggtgagccaccacgccaagccggcacataatacatcttgtaaaatatatttagcaaagtctatttaaaaataattaatagtttattaaatcttatgtagatttttttttcaaaatgaacaagcttctgtctttccaacaaagctttggaaataataatcattgcattttcctctaacaggttaatcagcagatcaactaaaaccaaaatgagtctttctctgggcacggtggtgcatgtctatagtcccagctactcaggagactgaggcaggaggatcacttgagcccaggagttcaaggaccagcttgggcaacatagcaagataccatctctaaaaaaaaactaaaaattaaaaaaaaaaataagtctttctataactgtatgacagggctaaggtgattttatttgacagaggaattaaatttcaatgtaccaagttctatccgtatgatatcttttctgatggttggaagggcaccaaggggcttccatgaagctcagtgacagcattttcacatggaagtcactgcagcggaaagtagggtacacattcttggtaaataatatatgattgcactattgatgaatagcatttcaaaagctctgctatttattgtctattgaaagataaatgaatccagcaagtaaactgcctaaaatatttgtacactgttataaaatgtaaacacctctatcatactataaatctccctcccctccgctggaaaagacttcaagctgagatcatcctcgtcctcatcacatgattgcttggaatagagttgtccctgaggccacctgtcacctaagaggacttgtattcatttattcagtgtccatgtaatgaaagaataagacagacatactgtgaatataagaacacagagttcaaaagactattctgattgagcagaaggaagatactaaacaaatattagatgaacaaagcttgtgtgtatggctttggaagataagcctaggatcttaatcttgtttatataacacaactattaaaccttcctgcgtaaaatacattttaattgagacttagcatgaagatagaacaccaagtctgggcattctgaaaagtttagacgcagaggaataactggcaggcagtgatttaaagtggatacagatttttgccctggagttgcagatgcgtgtaggaatgaaaaggaagtaatgggtgtgataaccgatttaaacactaatcagtgagccccaaatattaaccatatactgggattctacaaagagatgccatggtaaaaatatgaattcaagtgttttaacctgtatagctggatacattcttgtgatattaacacgggaaataagaaaagagacgagtttgaatgagaaaaagatgtttagctcaatatagcacacactgagctttaggctcgaataagacatctgagtggtggaagacttagtcaagcatgggagaagttagagctgaaacccaggtaaaatccttcaagttacaggcagaaatcattaccagatgtgtggtggagtcacacgggggatgtgagtcctaatgcctttgcagatgcatggggaaggcagtgtctttttgaaggactggttttagcgctgcaagaagtaaagtaaattctcttttacttgcattcttgttccctcatggtgcttttatgaggactaggcaagaatagtattgaaccacttataccatccatctgttagaagaacctataatacagaaatatttgctttgggctgaactccaaacgtaatacttaatgatttctcttcaagtttgttgacacattctacatctccacatacaatttgctcccagtcgtttctgagatatgctacagaaagtacaattgatcaaacgttggctgtagggattcaagaacagtcctgtgactgcattttcgttccttcctgaaactattccaaggccataaaacaccttttttgtgtgaactgtctttctgtatcccatttcagatgatatcttctttcctttaaatacagtcttttatatttttctaattgtctgattgccaaaacaatatatctgcattgctataaatttacagtatcaaagatcatacagaagaaaaatcttttttaacaaaagaaaaccattgttgataatttagtttacatacatacatatgtacatacatgtatcctcttagcactctggggcccggagtagagagcaaacctgtgaaacagatagatagatagatagatagatagatagatagatagatagatagaagatatagagatatgttagagctatagagatatagtctctagatagatagataagaatatctgtattctctctctctagacaaatgattaggaaacagtctataagaacgtgtgtgtgtgtgtgtgtgtgtgtgtgtgtgtgtgtatgctctctagaggtagaatatatctctctgtagggagagagacttatgcatgtgtatgtatgtataaaacaaagaaacaataaaaacacaaaggcccaaatatcaaccagaagaaactgaccagctgtaatgggacaattagaacatctgtaagaatatttgtactggatttaaaatgataaagacataaaagttcatgtattcatcatgacacccagaataaaactcactggttatattactaggccacgatcgcattttcctgaatcttgatcaataaaagaatcatgattttttcccacttttcctatatatattgaatttcagagtaactaaaaaattggtgattacaagtaaaatttcagataatatatgcagaaagaacaatactatctgaaaatcattattttgtgaaactccaaattaagtaagtatattaatctgtcctcacactgatctaaagaactgctggacactaggtaatttattaaggaaagaggtttacttgacttgcagttccacatggctggggaggcctcaggaagcttacaattgtggcagaaagggcagcaaacgtgtctttcttcacatggtggtggcaggagagagaaatgagtgcccattgaaaggggaaatcccttataaaaccatcagatcttgtgaaaactgactcactaccacgagaacaccatgggggaaactgcccccatgattcaattatctccacctggttcctcccacaacatgtggccatggaactacaattcaagatgggatttgggtgggacacagccaaaccatatcaataagagatctaggaaattatctctgattatttgaaaactgcgcaggtttatatatatatatatatatatatatatatatatatatatatatatatatatgtgtgtatgtatatatatatatatatatatgtgtatgtatatatatatatatatatggtgggattcattaccaactgaatgtaattatcaaccactcttaagataattaaaagtaacactagcaggtatcatgtaagtccttattaaattcagtataaagtacagagcagttcctgggtgcgttgtttcctacaaagggcaccataaccctaaggaagaaaaacaagatgtgattaggaaacattctgttaattctagaacatggggtgttcttcagcagtaatgttcaaaatgtggttcacaaagcagcaacttgttagaaatgcaaaatttaagatcctatacctgggaggaggcttcctgaatctaaaattgagggtgtgggttgcaaactattatttctttcccaaacccatctgtgatgtttatgcttgataaaatttgatgggacggttcattgatttccataaggaattaacgatgtaagaaaatgagaagaagaattgtattatggaaaagagggtgtcaatattttcacttgctttctctttaaatgtgtggatcacaagatttgcttttcattaaaagtattcagatatatatacgtatttgaaatacatgtgcctatacactaaccccaaaacagctcattaagaatctcttccactgggacataggcatcagtatttgttaaaatatcactaagtgtttagtgtggttgatgagtgtagaaagaatatattttcaccaagcttatgagatgggcagtttggggccaggagaagaaggcagtgaaagaacttgggtgataagcagctgtctacttgcaaaacaacttattattaatgaattgggactttaaatttttttttttattttcataggttttaggggaacaagtggtatttgcttacatgagtcacttctttagtggtgatttgtgagattttggtgcacccattacccaagcagtatacactgaacccaatttgtagtattttatcccccaaccccctcccaccctttccctctgagtccccagagtccattgtgtcattcttatgcctttgcatcctcatagctcagctcccacttatgaatgagaacataagatgtttggttttccattcctgagttacttcacttccaataatagtctccagtcccatccaggtagctgtgaatgccattaattcatttctttgtatggctgagtagcattccatcatatatttatgtaccacagtttctttatccgctcgttgattgatgggcattgggttggttccacattgtgacccaatgcttttaaaataatgtgtgtgtttggccacgaacataagccagaacactagaaaaattgtttactgaaagccatcttagtttcaggaacacaaaggaaatgaggtaatgtgtgaaaagaactttaaaaattgtaaggcattttgcataaagatgttaggtgctttttgaagtttctatttaaatgtggtcaattagagaggttttttttttttcattttatgtttgccttgaaagcatttagaagtatgagaatatataatttcattttgtaaaacacaatatgttgaacctaataggatctttcttggaaactgaacattgtcctgggttttggaggcatcccattgaaatttagccatgattccatattcagcaaattgctgtggacccagatacatcttcgctgaccagaagtctttccagagtggaagattttagtaaatgtacaagtcaatcttgtagaattagataaaatgcattctgttttccatcacttgccgatatccccccactgctaattaaaggaaacacaatccacaattgatttacttatgtaaatgtagattacaaaccaacaacatgattttaagagtcttaagaagttgagggctattttgaatgtttactcttggagacatgtatatttaggtgtcctggtcaacaagatcaattgtaggaatggttggtgcaatcacattggtcattaaatacagacatcacacataatcaagcagatttagctcagggtatgggtaactcaacatatgaacaccattcaaagtatttccccaaaaggctggcatggtggctgacatggtttggttgtgtccccacccaaatctcgtcttgaattcttgtgagagggacccagcgggaggcaagtgaatcatgggggcaggcccttcctgtgctgttctcatgatagtgaataagtctcatgagatctgatggttttaaaaaggggagtttccctgcataagctctcttctgttgtctgctgccatgtgagacatgccttttaccttccaccatgattgtgaggcctccccaggcacgtggaactgttaagtccattaaacctgtttcttttgtaaattgcccagtctcaggcatgtctctatgagcagtgtgaaaatggactgatatagtggcttacgcctgtaatcctagcactttgggagggcaaggcaggcagatcgcttgagctttgcagtttgagaccagcctgggcaacatggtgaaaccctgtctctataaaaaatacaaaaattagctgggtgcagtggcacaagtgtgtattcccagctacttggggacactgggtcaggaggattgcttgagcacaggattgcttgagctagagatgcccaatgcatctcaagggtgcagtgagccgagatggcgccacttcagcctgggtgacaaagtgagatcctgtctcaaaaaataaaaaaatatttccccaatggggacatatggcttaatagttagggttattgtttgtagtgatgaataggtttggaaataggtcagtggtgataattataccacattgtgaatgtaatgaaacaacaagaattgtacattttaaaatgatcaaaatggcagggtgatcccacacacaaagggggggggatagatatacatagatatcttcatatggtttttcttgttttttaattttttatttttttattttatgtatttatttatttgagacagagtctcgctctgtcgcccaagctggagtgcagtggcatgatcacggctcactgcaacctccacctcacaggttcaagcgattctcctgcctcaacctcccaagtagccagaaatacaggcacgtgccaccacgcccagctgatttttgtattttttttagtagggacggagtttcaccatgttagccaggctggtctcgaactcttggcttccactaagaggttctagtaaagtacatactggctggattcaataaagcacaaataggcagcaaatgcttcttacatctcaatctaatcggtagccttctttatcctcacccttggctgactaacgtgcataaagcataggaattctggccactcaaggatcttaaccatccagttcagtctgttgcaatttctcgtcacattacaaatttttttcactttcctttccggagaaagccatgatgaactactgcagtcgaactcgatctcaaacagtcttattatttcaaatgctaacttcatggctcatagattctgtatcagtaagcccacatgcttttaagtctgatttatagaaaacatgatttgccctcaaacaatgtaacctcccaacagattcatctttaccactacacagatagagctgattagtcaagacagaagaattgcaatagataaagggtttaattcctgcagagctggctaaatgggagactggagttttattgttactcaaatcagccttcccaaaaatttggaggcttgggtttttccagaatactttggcagacaggggctagggaatgagtgctgctgattggttgaggatgcaatgataggggtgtggaaaacagccctggtgcacccagtcggcctctatgtggggacacagaggagtcactggtcctagtaggaccaatcagttgtcagaaatgcaaaagcctgaaaagacatcttaaaaggccaatctgtactatgcttattacctgggtaatgagataacctgtacatcaaacccctgtgacatgcagttcacctacataataaacctacaggtatacccctgaacctaaaataaaagttttaaaaaggcaaattttagcttctagtgattggggaagttgcaaatcttgtgacctctggaataatggctggtaatcattcaactaagcttacatcttagcagaattcaggcctctctcattctttaacctggtggcctttcattacttttacaaaggtggtttagttttaagaggggctattatcatttaaactacaagttcaatttctcccaaagttagcttggcccgtgcccaggaatgatcaagaacagtatggaggttaaaggcaagatggagttggttaggtcagatctctttcactgtcataattgtctgactattgtaagttttgcaaaggtggtttcaaggtgaaaggactatactcttaaagagcataaaattattgcattcattgtgtacctgaaacaggcactcccccttgttgatagtttaaaaagaaaaaaataataatccctggatgttgcaataaatgaaaatgccatggcagaaactgtggaaacaccagcctcaaaacaccacattgatttgttaaacttcagagatccatggattgtcgtttccctcagccagcctgtaggatatttggaagaatttcagaacctcaaagatcaaaccatccaataggatgctgttagaagaactaagatttttgaaggcaggggatattcattagcctgcttttggaaaggttaaaacactctgattttgctagggaggaagagtttatggtggaagaaaggccaatgatttcctgcgtgttgaaaatcttcatactcctccacagaaacaaaataagtcaacaagtcattctgcagaattgagaaagagagaacagtgagtgaagaaaagacgtgctgaagacagaatcgttctgttagaaaattgctcgtgccttaggaattaatcacctctttctttaataggggaagaaagcattgccctgtggtattatagggcacctaaactgacatgattcgtcattgtcatataaggatcttcgatcttttctcccaagcaaagcctgatgccttttatgaacgatcgtgtcaaagatatagtgatggagacaggtgttgcagaacatttttggcatgaagcactaattagtaattgctaattaaatgggggaggaggcttgggtaatgtctgatcgcacccactaatcgtagctaatctcccgtcacatccctctgaactttaaagaagatcacattggtaggatgtgtcttaagtatccaacctcgcagttgcgacgctgcctctctttgaagctgcaggagatagtgactcccgattcaggcttggagtttttattgtcattgttgaacgaaaatcgtcctgtgactttctttggagccaggccatttcctcctttccagctcagagcatttttccacaggtgctcaggaaagctcatggaagaaatgctggttgactcaattggtatgcagcctcatcctctactctttttgttttaaaagtagaagccggcactcagtcactccttggaatgccgtcaactttggttagggacgtgctttgagggaattggtttgatgttattttagggcttaaagcagcctgtcttcatacaaacatgactgcaggtggccataataatgtgctgagcatcccttgaaatgagtgaatgacatggctcttggaaaaaagaaattgtatagaaggggcaaatatcatagttgggtagttggggaaggctcaaataaggacgtgaaaatggttaaaaaaaaaaacttttaaaaattctttgtctttttggaaggcatatccagtacagatttggacataaagttggattaaagtttatgcaatgaactaaacttgcaggaggccttagaaaatattcctagttttgaatctgagtaggagagtgtatgtcttcccaaacttgacttcaaaacatcagaagaaagcagtttttccaggtcaagctatttttcaatacagaaggaacaaaaaataaaatagattaactcataactttgctatcattaataccaaaattgccatttttcaactactaaggagaaattaagaatcgtatgccttgagtaaaatctagatcctcaactcacagaatccttctttttaaaataaggaaggccagttcctgatattttgggaacagttggggagatgtgaatattcattagcttttgggtgaggttcaataattacatttttttgtatgtgactaatattttcgctatgtaggaaaatagaggtgtatactatttacgagtcggatctagtggagtctgtaacttacgttgtttcttaagcattgaaaggagttaaaacaaaatgttaataactaattcagtgagaaagacaggcgcacactgcctttgtatacatgcacatattcttagacacagacacacatgtgcacttacgccccctcccccccccacacacgtactgttttccctgaaaaatttcttgtaggagtctgttgcatttttcaaaaaagaaaatgaaaatgtgcacagaaatgataccttgaacctagtaaaatttacgacgtcttctgggattgcttcatgttattaatattttagattcattttgccttctctattagccacatatatacacaaagatgccatggtatcataacatcaacctaaaataaccattatttatataattatttctgccacaaaattttttctcctgttcttcctctaattggtgggggtgagagttgaggagagagagaatgaagaagacaagctatgagatatcttttcaaatagcagagacacgtatgcactttttctatttggccaccaaaaatatcttgtgttcttttgtagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtaataatggcacccccagggtgggcgggcaaataccctgaaccaagaaatgaatggtcagagttcatatctcagatgcatgtcctggttaccagaagtcactctggcaacagaaaatgcccaaaagatcaaatgaatccatcttcatgtcttttaactcagcttttgttccatttgctctgtcacccaggctggagtgcagtggtatgatcatagctcattgtagcttccaactcctgggcttaaggcttctcccatctcagtctcctgaatacctgggactactggctgctttttaaaattttttatagagaagtggtcttgctatgtttgcctgggctggtctcaaactccaggactcaagcgatcctcctgccttggcctctcaaagtgctgggatgacagatgtgagccaccatgcttgatcagtaatatttttctcctaatttaaatgtgtgacaattaggtgttggttacaatgattggaacaaaataactactttagaagtcctgacacttttgtttttttttgccattctgactgtatttgactatttgaaattttattaacttctagctacaacttagtaaaagtagtatggaagagagacagtatgtcgataagggatgcgggtgtatagattttgtaaccatcagggcttttagccacatgttttttaagaagtcgctcctctctctaattcatattaattctttaaatcttctggaaatattgaaacacgtctggtgcattcatttagaagtagattctgggtagaagtagattctacccagaggaatagtgtctctctccctgatggtctccctccctcccttgctcttcccctcccattcttctctttccctctctcgtcctctctgtctctctccctctctatgtcctcctccctctacctctctcctgctccctctctctcttttgctctgtctctcaccctctctctccccctccttccactgtctctcctccctccctctctctctccccctcacactgtccccccactctccctgtctttctccctctctctctcttcctctctctccttttctctgtctccccactctcttactcactatctcctttcctctctctctttcccccctttccctctgtccctctctctctttgtttctttctctctctctccctccctttcttcttctcctgcaaatatgactttcaccaaaggacctccttcctggtcaggtcagcatgcagcactagggagtgtccagagtttgctttcccctctcccttcctctctctctctcctgcaaatatgactttcacgaaggacctccttgctgggccagtcagcacgaggtcctctgcttgtccccgtgggagctccaaaccctccctggggccctgctattaacctggaaaaagctgatgttggcaaagtggagaaagaggaaaccacaaaaacacatgtgcatcatgttacctcaaccagatgtgcacttgaacgtgtagtcagcataggcacccgtacccaaccagatgtgcacttggacgcctaagcagtagatggttatgctgcctaagtaatggtcagcataggcagccacacccctgagccctgctggagtgcctgaggctttccccggaggctcactcagtggattcccagctgtccctttgtgaaggaggctccctgcagtatccgatgagagacttcaaagaggagtccacaggaatttgaggcaattggttctggaagcaggatcacaaattcctggctgtggcctaaaaggaagaggcaggaaaatctgcagtgcagatccagccctgggttgcctggccacacgcaagtgaatattcctaatagccgtctcagtcatcaagacagctttgtaatttgttctgtgttgtcagtggtcttcagaatggcaccacactgactgaacctgaagttctcaaaaccttcatggaattttttttttttttcagggagtctcactctgtctcccaggcaggagtgcagtggcacaatcttggcttaccgcaacatccaccttctggattcaaagcgattctcctgcctcagcctcccgagttgctgggattacaggcgcccaccactgtgcccggctaatttttgtatttttagtagagatgggctttcaccgtgttggccaggctagtctcgaacttcctgacctcaagtggcccacccacctcgacctcccgaatgattatttttaaagttatcagctggatatggtggctcatggctgttatcccagcactttgggaggctgagcggggaggatggcttgagcccaggagtttgagaccagcctggtcaacatagcgagaccccgtttgtacaaaaatgaaaataaaaaccagctgggcctggtggcgcatgcttgtggtcccagttacttggggggctgaggtgggaggatcgcttgagccagggatgtcgaggctgcagtgagctgtgaggttccactccagcctgggtgacagagtgagaccctgtctcaacatacatacatacatacataaaattaaaaagtatctttctttagagtaactgcaggactttcttcacttcggcaccgtctggacaagtttctggatcgctgtgctcctcagtgtcttcattggcaagataggacagatgagggtttcctgaaatcctccaaactctgaattccttgagtttttagttcataatgttttgcccatgagaccaaatggcctttgatttcttactagtgctaatgagaggaaaggctcatatttgtattaactttatttcaaaaacacgataagtgaagaatctgatgaaccatttggtagagagatttctatggcatttttgaaaatacctcgattttcacttttctcaattgatataatcacaattgtagatttagaaagcagtcagaaccaacttcaggagtaatcaaacacatgtaagccacattaattggagggaggtgttaattatttaagtcaataggttggaaattattatacttttgcatcggtcatttctgcaaggcatgcttctaaacagcccatcaatataatcacgaattatgaaaaatacaagccaggcactgaggctcctgcctgtctatcatcccagcaatttgggaggccaaggtgggcagattgcttgagtccaggagttcaagacaagcctgaacaacatggcgaaaccccgtctctacaaaaaagagacgcatctgttgtcccagctacttgggaggctgaggtggaaggatcatttgagcctggaaggcagaggctccagcgagccaagatcccgccactgcactccagcctgggtagcagagtgataccttgtctaaaataaaaataaatatagccagactgtttgccttaggaattccttgcctggttatatggtctaatgaagacaaagtacacgtggaaagtgatagttttatgaagatgttcaccacagtattagtatcgtagcaaagaatgaaatgaaaagctacaagatcaaaaggagaggaaaattataatgaaccatatgtatttactcaataataatttaagaatttacctaagatatacatcagctggaaaaacagtttagacagctatataaatattgggctcagctatgcaaaacagacatttgaatggagggaaagagctaagaattatgtgaactcctagcatactcattacgctaaggtgagttgtgtttaaagtatgaattctgggtgatttttttcattatccaactattttagtcttatcaggagttctgttacttccctaacatacaaataaatgttttatgtatgttactttatatacactactgcctaaattattgccagtacttatgagaagggcgggaaaggaacttctcacagcattttttccaattctgaatgttttaactaatgaaagtatccaatagaatacatattgactttctcttttggtttttttttttttggacattttaaaataatcttcagagccaagcactcaagtcaatacttgcacatttctgacagaaacgttcccaggatggctttgatgacatactggtcaaagccatattggtttcaagttgcggtcctgtgtgtcatctttgggcaatcctccagtctttaaaatcacgtcttcctgatgacagttatattttcctcatatttgattgcttctgtgaccttaaaaatcgacagggcatgaacttctggactcacaactgaatgccttattctttagtgcccgactcgggctgggattcacggaaatggcaggaagcaagtgtaaatggaatgctgatttttacagcgcacctctcttgtcctatcgtagttaaaaatacagattttatacttctggacatccgtgtagtagactgaactcatggagaattttaagctacacagaattttactcctaaaattgcccatgctttttcaagtttctcagcaagtggagcatttttatatgtggcaaaataaaatatacacatctctgagtttccaatggatgtagttttgaaagaagtgacctaaaaaatactccttacttgggcacccagttgaggatttctttaagcatagctagctgaatgtatttattttaattggcaaatcttaatatcttcattagactcaaggtagaagtagaaatgcgctcctgaattagcactctgaagttgattcaagtggatttctttttttcccataatgaagagatacctagttttgcttgtgagacaagagggcctttgaactggtactagcttaaagcattttttttcttggaaatggggaatgcagttgctcttggagtttttatatatggcatctggaggcaaggaagcaaaaacgacactaaattgtggaaggaaaaagaaatcacatgtattttaccagtgcaggagaagtgtcaatgtggtttcatttccttaaactcgtgtgtgtgtgtgtgtgtgtagaataacattccctaaaatgaatgttcaggaggaggggtgaagggggaatggaaatgaaaatgggtaaaagggcccctgacagagctgaatgctactacatccagaaactcacatgcctgagagacaatcacagccttcattgctcagtaaaagctgcatttctgtcctgtgggttttcatttgcatgtccacaattttgcacctgcaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactgggtacgttcatcttcgtgttggggtatcactatccttgccacttgtttgtgtcctcaatataggtgttgcttctactgccacgtgcaggagcacacacgcatacacacacatacacatgcatgcacacacatacacacagacacacgcttacacacacagcagtaacaggcagcttctcccccaacatctatggcaactcatttttttctttactcctaaagtgttataggagtaaaacacttaactgtcaaaccagatttttactagagttctaattgcccattgggaattccagagttcctacctgcaggtgcaggactcatacatatatgatggttctgttaacagctgattaaacggttttgtttttgtccttgttgttttagagacacagtctcactctgttgcccacactggagtgcagtggtgcaacagtagctcactacagcctccttgaactcctaggctcaagccatcctcctgcctcagcctcctgagtagctgggactacaggtgcctgccaccatgcctggctaatttttaattttttttttttggtagaaagagggtctcactctgttgcctaggctggagtatagtggcgcaatcatagctcactgaagcctcgagctcatgggttcatgtgatcctcccatctcagcctcttgagtagctgggactacaggcgtgcaccaccatgcccttacatggatttttgtagacacagggtttgctatgttgcccaggcttctctcaaactcctgggctcaagggatcctcccacatcagccttctgaatagctgggactacaggtgcacaccaccttactcagctaattttattttgttagagacagggttttgctgtgtcacccgagctggtctcaaactcttgggctcaagtgatcttcccacctcagcctccaaaagtgctgagattacaggtgtgagccatcacaccagccctcattacagagttttaagtctaatttcaaccatatctcttttgttaatttgcaaggatatcacagcacatgtaccacttggggaactgtgttgattgcctggccataggaatgaaaacaaatatcataataattataaagaaatataaatatatattcctatatatatttaatgtctatataaaaatatagatattcctatttgtataatatagtacatttatatttgtatttgtatatatatacacacaaatatatttgtatatacaaatacaaatatatatacaaatactatatatatacaatatatatacaaatacaaatatatatatacacaaatacgtttgtattttctctgctatataaataactagagagagaaaatgaaaatatatgatatttgtatcatattgctatatgtcatgcatacataaacacacacacacaaacacacatacatgtgtatctcacaggaaagctcatttattggcctaaatatagtagaaaatataaaatatacaaaaagcatatatacaacagagtctgccaatattctgctgagcggattctctgcaaaccatgggagaaaagaacccaaaacaacctaaatagctccaaacattgtggcattttttcattttctcttgtctaataatgtaactgtggaaatggatggggtgtcattctgttctaccagtgtgtgcctccatcatcaccctgagcctctttacactgaatgagagagaaagatgtgcctgtcgcccagggagggtaaatcttcccgtgcggaatgaggctctgagactgcagtggccctgccacacatgagttatgcacagtaatccttagaagatctggggatgctggtggtttcaatgcctacgtgtttagcagctggcatactgtacaaagattccaaagtggtttgggtagggagtggtttgagaatgttttgtgcccttggcgaaagtacagcatgtttttggagtggaaaaggtatcacctggataccacctttcaataatcagactttgtagatttggtctgagaaaggctacccagaggagaagagaggagggacccacatttgatgcaaatgcttgtctatcactcaacggttcttttttgtgtgaagaaatgattgaaatcaaattaatactttttttaaagtaaaccttgtttattagtttgttgggactgctgttatcagagtatccaaaactgtatggctatgctgggcgcagtggctcatgcctgtaaccccagcactttgggaggccgaggcaggaggatcacctgaggaggccaagagtttaagaccagcctaggcaacatagtgagagtccgtctctacaaaacaaatgaaaaaatttagctgtgcatggtagcatatgccgagagtctcagcttctcaggaggctgaggcagagggatcacttgagctcaggaggtcaaggctgcagtgggccatgtttgcaccactgcactccaacctgggtgacagaccgaaacctttatctttaaaaaaaaaaaaaaataaaaaaaaaaaaagcaccaaaaacggtgtgtcttataacaacagaaatgtatcggttcacgctttctaaggccagaagttgcaaatgaaggtgcttgcagggccaagttccctccaaatctgtagggggagggtatttccttgctccttcttagttactggtgtttgggtgcagtctttggcattcctaccttgcaggtgcaccatcccactctgtgtctttgtcatcttacggcctccctgtgtgtctctgtctccacatggccgtcttcatataagagcatctgccaaggtgcattagaagctcaccctactctagtatgacctcaacttaacataaatagtcatatctgcagttaccctatttccaaataagctcacatactgagatactggggttatgacttcagcgtatcttaatttatggggagacagtattcaatctctaataccctgtgaaatcagggccaggccctcttttgtgacagcactgagataggcggtgtctgcccttgcagagaatttcatcctcttgaagcctaaagacttccatgagagtttcccaacatggctatactcattcaatcttcgctacattggcatccaaacgtattaccgacttggtctgcaaacactctctttacttactctcattaaaaacatatgctttttcttttcctccttacatgatttgaaaataaactttatatgattatcttaagtggaaagctagaatcattcctcatacattttatggaaccattaaaacaatagtgaaatctaaataatgctgttaaattctcattagctcttcctgacttccaaaggctatgagactgaggctggctctctcattattaaaaaaaaataccccaaaaaaaaaaagaaaaaagacagaaaaagataaaggaagttaattagttccatgaggtgatcgttatcactgctgacaccaaatggacgcttttaccaagacatcacgaaggtctgagagagccgtgagaagagaataccacaatgatctctctgttattgagtgcttttaatgccatgaatctgtttcttaaaatcacttggcttagagcctgtgatttccaccctgcatttagggaatacattcacgttgccattcatggtctgtgttgagggtgcttctagctttcatgaaggccctgacatggctggaagagatgaggaaggaataactgctagaacttggagagacgctctgatgctactgaaatcaaaagctgcaggtagagagagttcattgaggtacccagagctcgaatgtcagtccgtctgaagcctctatttttgtttcttccgcccatgggaaacatccctgaaataacactgagtgtattaatgcagtgagctcttttaattcattggaaaggtattagaatgactcaaatgattcctcaaggaagttactcagaacttacatctcatgtgaaatgcaacgtgtggattcaaatacaaatagtttaagtgatcacacctccatggcagccccataaaagaaggaaatggggaatttcactgtcgggcacagtctggtgagctaggtattcgtcagtggatgacaaggacttcagttgcagttggtagttatttgtttattgtaaattgggtggtggcccgatcactccagggcagagaaggattccctggtcaccaggtgcagagaatgaaccaaactgatgcccgcaaggagaaagtatgggatgcaccttatctgctgtcatggtgtgagctgccaagtttaacgccattttgcagagcacacactcagatgatgactcacagaacaggagggcatatttctgcataccatcactgttcccttccagcactggaggtgacaggaggaaacaagaatagctcccagcgtgtctgtcactacacggtgccgtggagaaaggatcgcattgtgccaggacatacttcaccactctcagtgggcgttaagtcaagcgttctaaacctgcaggcacagccagtctctcgatggcgcatgtgtttgccaagatgaagtggatggggtctggatgcttctatatagacatctcaaagtagatggttctgacctttagtctaggtttgaaggcacatatacctggtatacataaacctttggttttgggatgagcacagaaaaatgatgttgggatgtgcatggcggagaaaaggaaggaaggagggagggaatggaggaaagagagttcagacaaaggaacgaagggagggaaggagggagggagggaggaatttattaggagggcgggagggaatcaagaaaggagtaaaggaagggaggaagggaggaaagaaagaggtaaggggggaggagaggaaggaacgaataccgtcccgccccccccgcgccgcacgagcccaacacccgtcactattcactaccttcctctctccccgcctcctactatacacaccaaacgcacgtagaacccaaaactctcacagacgagtcaggaccatccattcatggtaatcgatcaaataaagtcgccacgccccatatccttataatccccatccttaccaacctcacccttctctgtccctccaactcattctgcctctctcacgtatctctgctcttcttccgataaacccgccgcttcgaaatgcgttcgcgtctcatacctcactgtctggagggtttgtaagggcagaatgacttgggctatcataatctccacaaagtttatctggctttaagaattctggctgtgcatctccgagatctttaatagacagacggtatcaggtggcagctcatttatatggatttcccaaatcctctgctttattcttcaagaacaaaatataatgtgttttctttacctgtcaaatataccctgagttccttcgaaaatagccttgtacccaacatgaacagaatactccttttcctagatgctcactgcttaatagatgaggtagccacacatctaatagatccaattcagtaaaattggatccatggaaaaaaaggtagaatcttcacttccatttgtttctttagaatattaaaaatcaataactaatattagtggatttttttcctaaaatattcattcacttatttttctttcagtacacgttaaataactgaaaattttaaaattatttcagaggacttaaagagcaaaagaaacatgagttgctgcattgaatccaacattttttcaaaaccatgtaagaatacatgcataataaataaaaaaagcagaagacttttcaaatatattgtttatcagtaaataagaaaactcatggtattagaacctatgagattatatatatttgttctcaccctattagtaaagtgaaaacacagcagttagtgtgcattcaactaaagggtagaggtcaactttctttttctcctgtattatgttatacatctaatatctatatctatagatagatatacacatacacatatatacacatgacatacatatatatactgcatatagtatatagttagtatgcagtataaactgtggtatgcagtatacttgtatatagtatgtaatatacaatatacttttatgcactctacaatgtatacaatatagaaattcagtatgtactctgatatacagtatatcactccctacttctccctcccttgcaatattataggtgttctattttttatattggaagagagggggtaatatttcctgaattcttaccatatgccagacatcttgtcattatctttcaaccttcatcacttacctccaaccctgatattttcatcagccatgtagaggagtaagttaaggccaatactggctggaaaacttgcttaagatttcacagctcttaactagccagagctgcagaaagttgaatacagggaaatgatttattttatcaccaccacagactcagactgaggggataaaatcttccttcagcaagtgtggcgcctctggctcaagtatattgtttgaatcctgcacagtgtctggtaatggctacagatacatgatcttccttggtcctgcagccttctgccatgcaggccatgcaatgactggaggcagtttcacagaagtcccgccaaggagaagttacctggaagatagcccttagctcacacctggagccattgatcaggatgttgcaactccctgcttgcctggttctgcacatcacatctcaatgctcagtgctaactagtacataacattttgccatgcataatctcaaatcgtttttataacaaataaaccttaagacgtaattgttttttagcttactttacaagccataaaaaaaatggaagaaatgagcatttggtaatttattttttgaaggggaagtgttatcctaaaagagtcagttgcaaagatgtttattaaaggccctatgttttatgaattatctccaaatttttatgattctccttctacctgtgaccacttgtgcaaataataagaagataattctttggctcatagtttccaagcacaacttagcatctgtaacagcccttgacttgtttctgggtgtcttttttatcttaaacatgttaacctcatcataactatatgtaccattttagcaaacttcttacagctaacatagcgtgctttcatctttttaccttcaaatagagagcaaacacatggtgcatatgtctatttacaaacactttgtaattataaagcctatttttatttctactgttaatatcaattttcattgctaaaactgcaacatttattcatttacttcaaaagcaattcttgagcaagaaagagaatacccatttcttggacaatagcttcttaatcagaatttctcaacctcagtactgttaacatttgggtccagataacttctttgctgtgggggtctctcctgtgcaccagagggtatttagtagcatccctcacctccacccttcatagaacaacccttcgtctacggaaaccaaaagtgtctccagatactgccaaatatccctttggagcaaatcagtcctggatgagttttacagttcgacaagagtgaaacttgaaatactgaaatttttcctagagacacttagttttccttctttccctttatttttgaagatcatttgatgccttaaaaaatagtaaacatgttataaaaattgcataatgctgctatcaggatttatatttaaaagaaaaataagagcaatttttaaaggaaaagacaacatggtagacaggtctaggattaaagcagaatgtacctttgctgcttgggtattttgtgctcattgataaatatatatgaagagcagattgtaacttcctgatttattggtttaagataatttcacgtcacatgtggaagagtatgacctttctttttttcttccttctatcctcagtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatatacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgcgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtattttctaatgctttgtgcaaataattatgcgtccattctttcttggtaggtggcgtgttttatttacttttgttgttctttgaatgtctttttctttgtaaaaactaagtgatgcgcctgacataggctacaaatagataaatacatttggtaatgggatagtttctttagctttggccagctgcacagttgaggaggctctgctggcctgattttggaaaaccaagccctgtttggtgaagctcctcaggtgacactgtctgaaacggagtgtttggatttgttatttctaccactgtgccttcttgcgtcactgtgttttgatttgtggtcaacaaaacactttcaaatagccttaggtgagtaagcctgcaagtgacagcaagaaattctaccgaatgaaactcaagaggcagaaaatcactatcataccaatgggagctcatttgtcaattccttcctgtgcatccaaccatcacgatcttatttgacattcgcagtagccctaaggggcacgcacctgcattgctcccctttcataatggaatatgttcagaggaaactagcccctattcgacaggagaacttgatggataacaggatagtatatcctcatagccaaaatcttttcaccaagaagttatatggcaaacacttgtaagccaaggccctgcatgttgtgataatcctagctaagtatcagataaagaaagatagcaaggacttggactctctgacatatgtgaactcctaaattcttcagatgttgtttgtctcaatcgtgttgtgaaggcacacaggagaaatacatagacacacatacacatatatgtacatttatgtgtacattatatatgtatatacatgtacatatcctatatatgcattatgtatagagtcatgcacagcataataacattttggacaaatgcaaataacatgatgacaatctcaagagattataataacatttttcttgtgccttttctatgtttagatatgtttagatacacaaatgctcatcattgtgttacagttgcctagggtcttctctccagtcacacgctgtagaggtttgtagtctggaagcactaggctataccatagagcctaggggtactgtaggctgcacctcgaggtttgtgtaagtacactacatgatgtttgcacaatgatgaaatcacctaacgatacatttctcagaattgatccctattgttaagcgatgcgtgactgtgcatgtatacattacatacactgtatatgcacacatgcatatatgcatatatatgttacacatgtaaatatatacatagatatcacatacttaaattcctgaagatgccaattccgttaaacataaatatacacacactcatatatatgtgcacacacactcgtatatccacacacaacatatttaatgtgctcatatatatattcctgggtgtgtgtgtgtgtgtgtgtgtgtgtgtgtatatatacatagaaaatacattagttctctttatctgtgcaatcacattctgcagtttcaggtactgtggacaactgtggtgtaaaaatatgtgagtacagttcaatgagatattttgaaagaggccacactcacgtaacttttatgacagtatattgttataaatgttctcttttattagttattgttcatctcttactgcctctaatttatgaactttatcaaaagtgtgtacatataataaaatacatagtatataaagggtttggtactatctgtggtttcaggtatccactgagttttgaacacatcccccttggaaaagggccattactgaatatacacacacctagacacacatacatatatacagatacataatgtacatagatatattcatagatatgcatgcacttaaatctctaagaatggcatttgcattaaacacacatataaacacatgtatatacacacatacatatatacttatacttattgtcatcttcaggcattcaaagtcgaatttttagcaaatttcagctggagggagaatcactcttgttttgactattttatgcattcttgttcattgtgaataacccaaggaatgctaaaaaatatatgcattcattaattcattcaacaaacctttactgaatatctccactgtcccaggccctgtgctgggctggtgttaaaattgaagaaaaaacttctcacaccataaaactcaaggggaaggcagagaaacacagaagcaaggagaggcagggggtgctggagatggagatggcacccatgctaatacgtggtgctaagaaatgtctggacactgctcttaacctagtctgggaaggttgggaacgtattctgtctgaagaaacctaagccagatctttccaactccgtagaaaaaatgacagtgggtggtgtgttgtggggaagatagaattccacacctttgaagtgagaagacagaggaagttgggaaaccatgctcctgcatcatgggtaaaaaaatacaaggtattttttagaaaggtgcgaaatacgaggcagaaagaaactggctgataaaaaacctccagaggcaaggcagggagtttgggctttgtcccaaagtcagggagacgccaaatgattgcaccaaattggtgtatgagtgtagctgggacatttagcagtaattctcaaaaattcacgttcttaggaacatgtaggacatctgcttaaagtgcagatccttattcaattgtggtttggtgaacctgtgtctgcatttccaacgagctctcaaagtggtgcacatgttgctggtcctcaactaaccccaactcttttaggttgcaaaggatggagaactgtccactttagaagtaaccgtgagcatagtttgtatcagagtgagagggctctggatgcaaggaaagcattaaggaggcagagcaatctgtttgagaaattaatgactgtcctcttttcaagggtgatggcgatagtgataataagaaagcaaaaaaaaaaaaaaaaaacaataaaaacattgcatcattttatagctgcatgtaccagaactgattaggcgcagtcatcaaataccacctggaaccgcatctgaagttaagcttgggtttaggaacttgtttcaacagagggagggcatacaaggagaatgatgagctaccttggagaggggttcagacgggctggtcaagggtttgggcttagactgggttgttttagaagtgctaagaggggcaagaacttgttcctggattagttgctatcaggataatggggatgtcaataacctttagccagaaagtgacaggaccagagcatgactagcattgtcttcagtaaaaataagcagtggaagagaaggggatttggggtcgttattagtggttacaaattgttcatgtttctgtctcatcccgtgctggctgtgggctgccttcttctgatgttgaagttctttcaattatttttatgtgcagccggatgcaccttgacttagccattaattagcaggctagttccagcagccagatatgagggctgtttcttttgttctttctcagaacttccagaatatgtactcatatgtcccatctctcaggccacctggttcaaaaaaaatctaggttatgctaaggaagtgaaagtgacacttcctctgcaaattctcattattatattgaaagaaatggggatacaggaaaaagtccacggaaactctacccttctctaaaatgaccatccgtgtaaatacttagaacacccacaaataatcctgtttcctctagaggcaagagaatttagggaaatgagataaattagccagggga

SEQ ID NO: 2 - DNA, 5565 bp, Homo sapiens
  exon (1)..(159)
  exon (160)..(936)
  misc_feature (465)..(3023): open reading frame
  exon (937)..(1089)
  exon (1090)..(1200)
  exon (1201)..(1386)
  exon (1387)..(2176)
  exon (2177)..(5565)
atttaagcgattttttttccctccttcatcgccgggcctcggataagatgacggcttgggtgatgcacgaaataacgcacgtgattgattagacctggcttggcttggctagggaacgatccaggcgcgctggagaccccgcgtgaagatgaaatgacggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagcagaaaacacactggctcatggaaactgcaagcatcgttgtcagctgcacctgcaggcaccatggggttgcaagtcagcatcccctttcagaaatgaggatggaattagagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcaatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatacacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgtgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctat

SEQ ID NO: 3 - protein, 851 aa, Homo sapiens
MSRPQGLLWLPLLFTPVCVMLNSNVLLWLTALAIKFTLIDSQAQYPVVNTNYGKIRGLRTPLPNEGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILAENTLAHGNCKHRCQLHLQAPWGCKSASPFRNEDGIRGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 4 - DNA, 335199 bp, Homo sapiens
  exon (10156)..(10298)
  exon (108500)..(109001)
  exon (205869)..(205928)
  exon (209526)..(209679)
  exon (235028)..(235139)
  exon (238090)..(238212)
  exon (310597)..(310783)
  exon (316139)..(316929)
  exon (326822)..(330136)
aggatgtgggtggggccagataacagaataaaagcaggctgcacgagccagcagtggcaacccgctcgggtccccttctacactgtggaagctttgttcttttgctccttgcaaaaaatcttgctattgctcactctttgggtccacactgcttttatgagctgtaaacctcaccgcgaaggtctgcagcttcactcctgaagccagcgagaccaccgggaggaatgaacaactccggacacaccgcctttaagaactgtaacactcaccgcgagggtccacggcttcattcttgaagtcagggagaccaagaacccaccaattctggacacacctgtgaggtcaggagtttgggaccagcctgggcaatctagtgggaccctgtcttaatattacattgttcctaaataattgtggtttttgccattaaaagtaattgtgaaaaccaaaactacttttgcacgaacttaataaaaattatgaaatagctgggcgtggtggcacatgcctgtagtccccagctaccgaggaagctgaggcagaaggatcacttgaacccaggaatttgaggttgcagtgagctataataatgcctcaacagagcagactgtctctaaaaaaaaaaaaagaaaagaaatgaaaacaaaacaaaacaaaacaaaatatgatgaagatccagaaggatgtgcagcccatctctttgccattcattacacttctgtcttcatatctacttcctccattttccaccggacaaggtgaaaaagcatgaccagttaggcctctaaatttacctgttgcccatctactcctctagagccactgtttgctgtgtacatggctgtgtccatggattgcggtgtcacagttgtgagacagatttccagggaatgcatatccatagtccagcttagcttacatgctcaatcttgtaccaagcaacgtggccagaagatgcaaatctctttggatagacccggaaactcctattttaactctgagcctgtatgaccagatgccttgaaggccatgcaaatctgtcctgcaggcaagagcttctccaatttcagcatttggttcagcatttggtgcaaatcaccagagaacatgtttgacacagttgacctggggtggagacccaaagttatgcatttttaacaggcttccaggtattaataacacccatgatattagatccaggactataatctgtttagcaaagtaccaaaactttagatctttttgtatatttggaggaaaagaacaagtattgcatgggtgttctttacataattttagtcatgacaattccaggagaatattaccaggctcctaatatgccagtgctttataacagatcgatcctcactcaaaacaatcccatttgtatttatacatatgttccatctgctctgtttccacttgtatacatacacaggtgtgtgtacttgtaacatgcaatacagtttttgcaatacattccctctcttctcaatgaatcatacctgaaagaaaaacaaaaggggtgtttttaaaatgattccaatacaggctttgagtttgaaagaataaaagagagccattgtcttagaaattttttgtcaacctcattttatttcaactaaaatttgtaaaccatactgcattcaccagagaaggtgtatatggctatatgcctatgtctgacactggtaattaaaaagagagaagcctgtttgcttgagctttgataaataaaacatattgatgctacctcttattatgtcttccccctatgttaaatgtttctttttgaaaatatagattatttgaagtacaaagcaagaaagcaggaagagagtgtatgtgcacacacagaagagagatacaatcaggcataaatccaccatcctgggaatataaacccctctgtatcatatacatatatatatatacatataaaaatatagatatagataaatctctacatatcaatatatagatataactatacatatagacagatacatccatatctctatagatatctatagaagctacagatatacatatatatttctacagatatctacagatacagatatctatagagatagaggtacagatatgtattgaaatacacatagcaatctttataaacacctattatagagaggtagatgtatggatctatatagatctatctatctatatacctatttctaaatctctctctctctctgtgtatgtatatatatatatatatatatatatgtgtatatatatatatatatatatgtatatatatgtacatcaacaattccaaggtcccaattaacttggagaaagatttatgtatatttgcatacttttaaagggtagggcatgtgccattcatcaaagagacatatacattgtaaaagattttcatttaaaagtcttaggcaagaacattggtgcagtcactgtataatgtcatttaaaaatgaactctatttagggcctcttatttgaaattcaatatcctttgttttcttacaaaagcaatagttaatggatttctcaccatcaatgaatgttacacaataaatgatgtgttatgggtttgaaataacaggtttcagaagactaaatccttcaagaaaactgaaatatcttgcccacaaagaaatctttattcccatttatcagatgcaaaacttgaattaagggcctgtacaaccttcttactggaaaacgtgaacttaaagtatttccgtcaaggtttattaatcttataaaatactttccctacaaaaccaaggggaataaacaagatcatctctttatctcttccaactgtatttctgtaactatgtttatgtgtaaaaaaaagtacctccatcaactatttcaagaaaatctcatttaagtgactgaaattaattttaaatttatgataacccaacttaaactggtctggagtttacttgatatcattgaaagaaaaaggtttatttagcaacagaatgaaatttgctaaaccttaagggtgcaaacatttctaaggtatatgtcatattactcttattgaatccatgttgttaattatcttactctgtaatctagactttaaatcctgtttgggaataacactccttaaatgttttctaaaaaattgagtatgttgtttaccctagtttatgatttatatatagataatatataacttaacattatatattttaaatatataatatctatattcatatgtggatatagatagatataggtatcaaaacagatattatacaaatgttactttttgtcctatgatttctgatgtatattaaaacttatgctctgaactggcctcatataattgtgaaacctgtggcatttatcatcaatatgttgcagagacttttttctaaaccatgcctaaaatagcaaataaaagtaagaaacaccataaataaactaacagatacataaaaataaaatgaggaaattgtttggattagaaggggcatggggtaaagaattaggtatgtgagagcaaaaactatgtcttatttatccatcttttgtattttgcagagtttgtggaaaagcaacagttctcacattcatgcttagtgaataagtgaataaaaacaacaattagcaaaccacttaaaaatgacccactgtgaatcacaaggtcaggagatcgagaccatcctggccaacatggtgaaatctcccctctactaaaaattagctgtgtgtggtggcgtgcacctgtagttccagctactcgggaggctgactcaggagaattgcttgaatctgggaggtggaggttgcagtgacctgagatcccaccactgcactccagcttggcaaaactataagactccatctcaaaaaaaaaaaaaaaaaaagatccaccacaagcctgctatttctgaatttaccttatctttttttttctttcacattaagactataattatgatttcaacttcctcatctgattcccagtcatgaatctatctaacatattcagctgaaggctgtcaatgttgtactgattccaaaatgcaatgatactctcccattttccttcactcctaaaatctctgaagactgtgacacaattgactcctgcctactccttgagaaggttacaatccttccttgaattccatgccatgttttctcttgccagagatctttgcagatgggacaatgaccctatttcaggttgctatcaagaccctacccagtgtcacttcctccaaagatttgcctttccttttaagtgaacgctttctctattttacaccaaaatgttaagtatcatatccacagggtttgtgctcagatctacagatcctactttaagatccctattcagatcaaatctcctctcccaaagatctcaggtctgtgggtcattggtatttctatgatccacaagcatctcatttttctttccatacaagtgactttgggtgaatgcactatcactcatcatatccttcccatagcaccacatcaaagctatctttagtcttttctcattttagggctccatcccgtttttactcaacttttgcaactatgcatatagtcaaatgccatccatagtgaaaaaaatttactactactctgaaatttccctattactgggtattttcactactaatatcctaatttatgaatgctgcagtatcactgtcctcttttgttctagaatgtcccggatcttaaattccctcagagtaaattctctgaaaggtaatctctgccaccatcccccactaacaccaataaggattccagtcaatgaatattcataatcctctgtagtccagccttcttattctcctctttgaatcacaagaacctacaagtagctcaccaccattcctgttctcagagtttaacttgagtattatctaataaaacaacctcatgtagcagggtggccccacatattcaggttcccagaactcactcgagacctgtgaagtttgaatcctggtgtttagctctagaggcatggattttgtaaccatcttcctgggtcatccttgttgaccttgaagttccaaagcctctgctcactccatatctatttctcttctctagatattattaacttggaataatttcccatatctactctccaattccccagaaaaaacttgttctgtgaacctttttctcatcatcccaataggatgcttgttatgccttctgtatgctttggagatggcatatatcacacattgagttgcattttaataattgaagagtttaatttattcccttattagattttaagcatcttttatgctatacatatttatctttccaataatgattaataacatagtatatattattattgcactaacaattatcctactgaaaatatttgtttcaatttgaccattgtattaggagagtcaataggaatcagtagtgccctatagtgtatctggcttcaccagtattgtatttcgagttccacatattgatcccataggagcattaacataatagtatgtatgaatgtatgtatgttcataatagtatgaacataacagtatgtagaatgtagttgatgaagacactgagatggaaaatcagagagaacaagtaatgtggtatagattatgtctcatgtttcatccagttctttgtaccaaacccagcttatatatccttctaggaaccctactgttttatttcattttatgaatcctcctagctcccacatctcaccatactccacaattagatttcaagtggaaacatgaagaatgatatccttatctcttccaggaattcagaatttaaacctccgaagctcttctgtctgtatcgtaatcctgtggctcagttgttaagaactggtgttttaggttctatcctggtcacttatgagggattttggattagggaaaattataaactcataatatcttatattcactttttcttataagcatgattccatttgtctaagatgctttcttaattttttttttttttgagggagggtttcattctgcaacacaggctggggtacagtggcatgatcatggctcactgcagcctcaacctctctggctcaagtggcccaaccttcagcctcttgaatagctggtaccacaagcatgcactaccactcttattttaattttttggtagaaacaggatctcactacattgcccagggtgatatcgaactcctgggctctagtgttccccctgcctcagcctcccaaagtgcagagattccaggcatgatccactgctcctggccttttttttttttttaagaaattaattaattaattttaaaaagtcttagtgaagtaattcagacagaagtgacttgtctgctctctcccaggtcacatgtctcagggaagagatctgctacccaaccaatgcacccacaaactaagccaagcattcagattttgcccaaaatctccctcccaatctcactttatcatgctgccttaaagtatttagagttgatgtctccccacagcaatctccactcccttcccttcccctctcccctcccctcatctcccctgccctccactcccctccacttcttttctgtcccttctttttctccttttctctttctctctctgtctctctcattcaggacttgatttgtcacagccattcttgcaacaaccttacaaacattttctttgctttccacattggccctcttcaactagttctccatgttgccatcacagtgattgtcctaaaacataaatctgattatttcttcttccctcactgcagaaaatgtgttattggctttcccactgcctactggataaattccaccttttcagcatgacatttaaaactcttcacaattaggtctctaatcctttcctcactaccttcttttcaaattcaatgtcctgccatgccaaaccctccctatttctagatctccacacatacagtattgctgcgatgtctttagccatggcttctttttcaacttcttcaaccaatcagtgtcgatgtaccattccttccctactctgaatgttcttcctttgcaaacccttggttaattattttaacctctatgggtccctattaatttatatgtattccttgtacacaccttcctgtaatcacatttttttctcatgcttttcattatcttgtctactataatgtatgctttctcaaaaataaatggataagtctcactcacagttacatgtctgtgcttaggactgtgtcagtgctaaaaaaaaaaaaacctgaacttatgaataagtcaatgaattaatacattcttggcaaagtccatgactttgtggcctattataaattagtgtgttcaagttgaggttctggtttagtttaggacatagatatctatatatagtccatatatctacatatatatgtctacatccatgtatatcactgatttgggggataagctgtatttataaacaatactatcatgttaatgggtcttcaatatctacacaataatggaaaaaagtatatgtatatttctaaatatctaatgggaacacacacacatatatgtatgtatgtatatacatttttctattattggctatagatatcttttaatagataagtgtatatctatgtaccaatcttgttggcaaaggatgctttcatgcatattatctcatttagtccccacaaggaaaagcaacccacaggaaaggtaataataatgtcagctcaacagagtcacagaacataactgactttatgacaaggcaaaatttgtgaggatagagtcttaacatgaaaccaggtccccagattcatgtccatcatcttccccattattgctcatgttgtccaaaatccttcgcatcatcatggaaggcttcatgcttaggtttacttcctaaagcagaagcaattaggagaatgtcctatgtgttgtggacattatcttttttccttccataaatgaattaatgggcaatgaaataattttaagaaaagctaacttttatagccaggtagaataaaagtaatcaccatgaaatattgtgaagataagcaggccccacacactagctcagctaatcaatatgacaatattacatggagattatctgttccattttacagatgcagaaatggaggcgaatattaaaattcattcctaaggtcacatgcaacttaaacccaagcaatctcattttagaatctgtgttcattgccacaacattctatgatgtactctgatctttgcattgccaatttaaatccaactttcttgaagccaactttaaatactgggaactttaagcattgtcaatttcaagccaactttctccaacccaattttaaatacaggggtcacaccctcctcctcgccccctgcaacttgaaactccctgggaaagataacctcctggacctgggaaatgaggagtatttagaaacaactgcctcttggtaagcacacctcctatattttatccaaatcatgaaattataacaatagaagtaaacaaaaagccttcattcatcctctttcaaccataacctcggcataaaaagctcctgtactttacagagctgtattccaattttcgctgctcttaaaattttttttaatatcattgcttcccaattgactcacaataacgcagacatagggactgctggagactgtgaccttaaacagttaaagatgtctgcatatacgacatcatgtttggtgtggagagtacctagagattcctaaaaaagcaaagaggaagaaggtttgctgtgcgcatctgggtaccctgctctatctccagggttcccaggatctctctgttacagctggtttgcactgggattagttgctctttgcatgaggttgtagctgtggacgtgggttttgtagcgattgggacgactctggagatctattggctgctgggtttgtaaatttcattcattttggtccaatggcagaaggagagcgccggaagcagaaggacctctctcccctagctctctttttcttgcagagacatctttctcccatctctgtctgttagtacagagctcttattcagccactagctcggcctttcctgcttcaattgtaatgcttgttctgcccggggacacactattgacagcagaaacaatgaatttcctccaaacccggcaatgttggtggctcttgcattcctctggatgagcgaatctagttggggggttcccgaaggggaaggcgcctgggctttcaatacatcctcctgaatcatactgcgtttcaggttccttagaaaaatttggatgtgtaaaaagaactcttaacggcgatgcaggtcttccacagctaaggtaggtgcagttttaagacgtgtctttcgcatattattatccttattttaaaaagccgtttaaacaatttgacttgcagtggctctccagcaaaggagggaaagcctcactggcgatatttgagcttcatttcatctaatatttatttattttttccttttattattattattattggacaatttgggctggactctctcccatctgtctcgctccatttctttggtgtggatgggaatgtggacatcgatgtatggcttttacatgcaatctctccacaggaacatttggttttattttcacttaaaaataaaaatgcagaccaccaatgttgtttggaagcattttgctgcaatcagctgtttgaacagctctggggccatgtgcggtgtgtttaaaaagtagcgctgccttccatacaaattaaaggaagactgtggcggggaaaggaggggaaaaatatatatatatatacacacagacatatatatgcgtatgtgtgagtttgtgagtgtacacatacacacacacatatatatatgtacacacacacacatacatgcagtacaggggaaaaggagggaaaaggccagggctggagatggcgaaagcaggaggacttctgcaaactgtgagcatggaaggcttttcttctcttttctccccactccaaagccctcgtcttctttaagaaaaccaccactgcctggggtgcttcttttgggaggctggggttgggggttggtgccattaaccagagagaaaaggggaaataaagcttggttggggttgcattatgagatttttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactgtagctccgtgctgctcctccaaactcgggagcggtatccatgcacccctttcccgtgtgtgtgggttacgacgtgggtgggagtggtgaggcaagccgcaaaagtggggtagagctggtggttttgcttcttcggaagcctttgagtgtggcctggaccttagatgggggtgcagggcggtttgccgctgccaccctcggcaccatctctgaactgcccgcttttccggaggagcggaaaagttggaagccgaaaagacaggcgcccggagccctggtctaggtatcaggtgatccggagccctagtcggtgcccactaagaacaccccttctcccatcgggggttcggaggagtgttaagcctgcgggtctgccagtccctaaggtagggatgggggaggggtctgaggaatccgttccaataggcacaccatccccacagccctagaaaaggcaaccaccacccgctccttcctcccgcaccatcccatctcaaggctctctgctgacccgggccgatttcatctggtctcttctcccccgcttcccacctcccaattcccgcgcagctcggctccgttccctcccactcccctaggcggaactgaaagcgaagatcagccaagagcacagtcggaggcggcagagacggtggcgggtgagctaggggctgtgagacgaagcagggagagagtgaacttcagccccgtcccctccccactgccacggctggggcaacccaacccgcgcctgaagcggcttggcttgacctgcggaagcgcgggccgggatggcgtggggagagggaggtaggtgccactgggctgcagatgacgagtgggttgggggcttgctgtgggacaagaggttcaggttccggcctgcgccttccactccgcggtggcgctctctgcctgcggttttccaggaggccgatctaccccagggacactctcatccttcaggcggtctcctggacgccctttcctccccttgcctcccagcctgacctggctctttcgcccctcggagaaccggtaggttggggtccctcggcgggggtctagtgagccgagtcgcgagctttgcgcccccggtatctaggccccgtgccgcgcgcaaatccgggcccaggcgtacagttctggagcctagtcgccgccagacacagggccctttgtacccggaggagcgggagcgggagcgggggcgtcagggcaacccttgcaccccagaggcctgcctaggaccaccctgggaacaaatgtctcgctcggaaaacgaggtgaacccggaggatgtcctacgcatcatacccctccccttcttgagaaggctttttctttttttctttttttttcccggtttccttttctctggcttcttccacaccttaccgcaggtgtgggcctcttttcatgtatgtgcggctgctatctcggggatgcaggggaaggcggtgtaggaggcagcgtggaagggtactaggaggtggcggcgggattttgggcctggtgatgtgcccgagcttgcagctagctggggcactgggcccccaagtcacgaattcagcccagggcttgggcgagactgcccggagcaaggacggaggatccagatttaccatttggacccaaattaagaaatttggggtgggggttgggtaggggttttgaaactaagcaggtgacgtccttgcgagctgaatccacaaggtggtagtatggcttatattatttttattttattattttattttatttttctattgttcattttttttgtgtgtggggagtgggggatgtttttttctctgtgtactccaatcttatgctttttgaaggcatccattgcccgtagggtttacataagaccgcgttgcattatattttcttaaaagtggggtggtgtgcataagcttccatttcagaatcagtcgctcctgtgatgtgagggaggcaaaagcaaagaaaaggaaaaataaacaaaataagaagtttagggagacttcattatccccacgaagccggaattgccagtttgtgtggtcgttctgcgggcaacatagaagtgcgtgtttcagaaatccttggatagcttctttcttctccaactagaaattaaatggccagggtgcaaacacctgactttgatgaaaacaaagtggcagaaactacaagagacctgattgctttcaatgaacgcactgagccttttcctagaggatggcagagctgggagaaatcagatctcaaagaaatctacagttttgtgagggcagatttggagagtggagaattatttcatacctttagttggccctggtgaagatgttagcagtaatccatcaaatccttagcatagattttcctgtggaaatgagcaaaatgttaaggggttgggggatggctatataggaatttcatggagacctctgcaaggatgtattttctcagattagaaatccggtattttattacacaatgcaatgaatgcattctacacacacatgcattccatatttctgtatgtgtgtctgtgtgtgtgtgtgtgtgtgtgtgtatgtagtctttttaaagagtatctttgacatgtaaaaacataatcagggccattgtaggaagtggaaaattacttcatcagttttaaatcagtggattaaaatcggaggcttgattttgtgtgtgtgtgtgtgtgtaacactagaatgataattgcatattcataataatgtttgtgcttggataccattttaaagttgctttgatgttttctgctctggtgaaagaatttttcttttctttgtgttttatttaaataaactaatgcttcatatacagtaggccctaaaaccagtaacctagctgatttttacccaaacctaagaatataacagatacttggtaagggactagtggctgcataaggtagataattatgttatcttgatgctgtaaaatttacaagcagacttgaaggaatttgaaagttcacagttttgggcctggaatgtagactaatggtaagcatacagatttgtttttaatttgtgaatttggctttttcatttttgtgtgtgtagtaatttgtggaaagcttatagtctctccacaaagacaggagcttttgactgactcgccatcagagaattgctttcacaagtgcaggggtctctttaaaatctctttggaatactgtgcttttatttctacaccacaaaaaaggatctcacaaaagtaaacattcaagtgcatgaccgaatgaccttttttaaacattctttcattttaattggtactccacacttcaaacctttcctaaaactttgaatattgtcaataatgcaagttgctgagcgaatattgtgaatattgcattcaaatgaagtagcaatataaaaatattttaagtcatttaatgtcctccttctgaagacaggcgtatgtggttaaaatatacttaaattccaaatatggtgagagccggtcttaggatgtgaatgtcaagtttaagcaacacaattttagtttgtaaaccagaatgtattctttctatactactttctgatttttaacaatatgtattctattcctaaatgggaaaaatatgttcagttgagttcaaatccattgctgttttttgtttttgtctgagtactacactttttcagaggagagtcttcatctcctacttaattatgtgaatggattttcagacagactgtgccttctgtatagccaccttttatttcttaaacccctgagctacaagttttaaatcaaagatacagcttttgcccagtcatttagagaaagtgagaatggaaattgaagcccaggccattgaggcaattaggtcatctgctgtgccctctgctaccattcagtcaatgaatattttacagtttcatcattttaatctaaacaacctacatttggactttgaaaggctccactgttttttgttaagtgaatggcagtgtaggaaacccttcctcatttttcttggggcagagtggcacacatgaatgagaaaaaaagaaggcgatacctcctagcagtttgtcattgtgacattcataggctttgaataaatgtgtagatgaaaaggccttctctctgcaggtgattacatgaaataaaaaataagtaaataaaaggctcataaaaacactacaggagtggaaggttgatggtggaaaacagcctatctaccttgggttgagatttcaaactttagacattttgtgttgagttcacatgtccctgatgtatggggaacacctccatataccacatcttcccaaggcatgctcatcttcccagaaatggtacctgaaggagagcaggcctaaccccaacaatatttttaaaaactctctctatatatgtaactatatatatagagtaaaatctgtatcttactgtatattatatatatatagtaatatatattttaataaggtttgtatttataaaggaaagaagtttaaatgactcgcagttcagcatggctggagaggcctcaagaaacttacaattatgggaaacgggaagcaaacacatccttcacaggatggcaggaaggagatgaatgagaaccaagtgattcatggaaagccccttataaaacgatcagatcttgtgagaacttactatcatgagaatggcatggaggaaactgcccctgtgattcaattatctcccaccacgtccctcccatgacacatggggattgtggagccgcaattcaagatgaggtttgggtggggacacagtcaaatcatatcatgaggttttattatttaagacaggaaaagagtaatcgtccatactttagacgggagatgaagtacagtgaacattcatagtcccattggttgaagaatacatttcgaagagagaaatgttaatttcattatattgctaatgaaatgatctaggctttcactgctctctggaaatgtggagaagtggcccaggatcttgtttgggttgttctatttaaaatgtacattacataaagaaatcatgatttgtcaaagtaacagagtggtatttttggcttacaatgggactttcttagctccacctgttaatatcgatgatcattttggttttaagaggccagtatctgattggatgatgaaaacctggatctcaaagccatcaccccagacatgtgattttattaacatctgtgggcatgtctcctggctcccacatcaacccttcatccaggctcattttctctgtttttgtttggttgtttgtatgctttgggtggggaaaggggacacatattttgctaagggcacctttttcagtcatgaaacgtagcctgtcaataagctgaaaaggaacttgagttgtttcaagttgcattaggtagtaagtttttggatcctttaaaaaaaaaaaggactgaggttactaaaagtgttattggcactgataaaagagccatggtgacttgtggtttgttttcacaaggtgtggaaaaggcctccttggttctttgatgatggctgtagtgaagttgcatgcggtgccattttccatgtttagtatttcaacaacaccaatatgtggctctggagtatgggacgggcaattccaagaactcagtgaggcatgccatgtgactccaatggtcagtcagagctgttcagcatggaactatggtcccaaaagcatgggggatgggggcagaagaaactcattgcaactgagtgtctttaacttgttccagtcctcactactctctgtgaatataactctgtgagtgggttaggtgaggaaactcacaaaagtaaatgcgtgttttcacaaacaaattttatcattgttaactgttttcctaagtgagacaatatgccctcatgccctgaagctacactgtaagaatggcagtatgtatgagcaggtgtatacacatacatgtgcacatatgccaacacactaactaggaactagtccttgcagaaaatgtttttctcagccattctaacacactagataaaagcaagtatgtgtgtgtgtgtatatatatacacacacatatgtacatacatgtataaacacatatatgtacatatatatatatatatatatatatctgaaggaaaaatatcatttttcattagttactttcctttttttattcccatcattcaccaaacctatgttatattaaacaatccataacacctggcctggacaatagagtgagaccctaactccacaaagaaacaaaaattaaaaacaaagtagctggcactaggcaagtacctgtggttccaactgaggtgggaggatcacttgaacataggagttcatggctgcagtgagctataattacaccactgtactccagcctgagagacagagcaagaccctatctctaaaaaatatatataaataaaacataaaaaataaaaatagaaaatttacaatgaaaggtgtaaagttacctatgatgggcctgggtgtaatcttcatttaggagtgaatatattcattaaagtgagacctaagtagtataaagtatgtgtttagggacaggtgcccattttctctaggtctcctggaatattttttttctaaattgagttctgattccaaaaaaggtgttattgcctatgcttatggtgaaactatatgtgtgacaaaatgctactctgtcttgtccatcaatattgtgcaatgtggtattctttcatggagcaattgacaacttttacagtgatcaaactgggcactctttactaaggctaaattcataacccttttatctgactttgtagaagattctcacctttatttctctcggtgcccaaaggctggcctgagagactgttcccattgaagccttacagaaagcttgtagagcattgtaacagcccagcttcagaaacccagcattgactttcaataaatatgaaggagtttgaagtcacaaatgttgagaacctcattatagtctctttatgaacttgagtccctctcttcctgcagacttcctttgaactcaaatttaatgtgcactacttattcacccttgtacttatggaaaagcattgacaatcccaggtaataactagagaagaagtgagtgaatgctagagggtttctcatttaggttgttcactcaccactgtgcacaggctctttagaaatctacttacacatgatgagactgtaagcagacttatgtttctgaagcatcagtatacaggtgtgcagaaagaaatgggctaggtcacttaacagctacgagtataactaagatggacaaaatagttttatttgcagattatatctatagagccttcatcatctatatctatatctatatataaaatagggtgcatataaacatacacagatcatagattattcatttcagtttctacatacaatatgtaatttatatacaattgcatttatgtgcatttatataatagtatttgtatacaacttctatacttgaataaaactgtcatcttcaatagctgtttaatatatatttatttctagatagttgtatttatgtacatttacataattgtatttatatacagtttatattactgatgaaagcctttatcacttgcaaacttacttatacaaaatacaatttatctaaacataaaatgtattatataaatataagttatatattaatatatagcatatacaataagtcataaatatataataaaaatgtgttttgtatacttatttattatatattgagtataactcatttaaatacaatttttatattatataatgtattatatattgtgtaataaatataatttatatattgctattatatatacctattgtatataagatataataaaatccatctaaatctataataaaatatgtatatatttatgttctgtatatgtatttttcttgctttttatgtattaaaaatacatacaaactatatatgtagtatactgcaaactatatatatagacatgcattttccaaaagaaactgtgttataggtggtgagtgaacttctaggctgattcacaggagctatggttactatgcgtagtggtccatggaaactacaactttactttcaagtggagcataagagctataaatgactgtaatatgatagcaagcacatcatggcactctgtgaatcctgagaaatcgacctttcgtgtgttttgtgaaccagtcaggaaagctcatttgagtgggaggatgtgtcaagccatgtgtctctcccaccgagatggatagacaacatctgcttatagactgagaaactacctgaggttgtgtggaagtcatgacaaattggcaatgtcctcagtgtgttcggggtgggaggtggtgatgtccctggacctatgcttagcttttatccctctgtgggaccaattctgttggcaaaatcacttctgtggtcttgctccagatgaaaaatcaacatggaaggcttaggggtttagtgctctagttaatggcaagaaagaaaatcagtgactaagatcaatttatccttttgtgcaaaacagcttttttattggaggagctaggtcttatatagagctagctcttatatagagcaggagctagctcttatatagagccacctagtatgttctttcatttgtcatttttattgatcatctactatatgccagatacaggccagaaagcaaattctgagctggtaatggagaggcaaaataggccatccctgtactctaaaaaatcctgcctatgtgtggatgttcacaagaacgttgttaagatttttagttcaggtatggattactttctttcatttttgttgtatacattacattttttttctttcatcctcatacctctctccttcccttccttccttcttcccttacttccctccctccttccttctttttctctattttccttcctttttttctctccctccttccctccctccatccttctttccttccttccttccttctttccttcctttcttcttccctctttcctttatgctatttggatgagtgataaaatctcaagggtccttaaaatattaaagggaaaatgaagataattctattgaagaacagatcaaataggaaagagtaatgaaaagaaagcttcctggaatgagaaattagcatgttctttacaatttaatagaatttttcatatactatatttgtatagctggttagattttaaaactttgtcaaaccctacatttataaaaccttagttttcattttagtaagttatatggatgaatgcacacataaagcagattaccttgattcaacaaaaacattcaaatattagtgatcctttttttttaacatatggtagtggaaacagcttgattaatttatggctatttcctacatactttttaaaatcaataagcaacagtcagatatttcagcatttttaaggcatgaacagtaccttgaattgtaatatattttagtctaaaacatctggtaacatcacaggtaattgcttcaaactctactgccgctcatataatttacttttttcatcaatttaaggtcttttagagtcatgagaggacctttaaaatagataacatcactcatactattgagctaggattgcttaaagatggagcatagattacattgtctcagaggaaaatattttatgaagattcttttttttgtgtgtgtgttcttggatacatgtgcagaatgtgcaggtttgtgatagagttatacatgtgccatggtggtttgctggacctatcaaccagccatctaggttttaagccccacatgcattatgtatttgtcctagagctttgcctccccctttctcccaccctgcaccaggccccagtgtgtgaaattcacctccctgtgtccctgtattcccattgttcagattggacttatatgagaacatgtggtgctggttttcggttcctctgttagtttgctgagaatgatggtttccagcttcatcacgttcatggaaaggacatgaactcattctttttcatggctgcttagtattccatggtgtatttgtgccacatttttttctatccagtctatcactgatggtcatttagtttggttccaagtctttgctattgtaaacagtgctgcagtaaccatacatgtgtatgcgtctttatagtagaatgatttataatcctttaggtatatacgcagtaatgggatggctgagtcatatggtatttatggttctagatccctgaggaatctccacacactcttctgcaatggttgaactgattcatagccaacaaacatgtgaaaaaaagctcatcatcactggtcattagagaaatgcaaatgattctttaaaaagtataagaactcccgaatcaggtattctatcttgaagaggctccctggtccaatatttctggaaaacctcatgtatcatttgcctctcttgaattttaccctgaagacagacacattatggccttaaagcctcctatactaatggatttagcaggcataccaaataacttaaggttggttctttgtaatgaattttaatcaaattaactacctaacagtattcagaatacttccattgacacagagcagaaagaagtgccaacaggatatgaagtatctttaaattaccaaaataatttggagaaatgaacttgttgattttttctttattttatttacttattcaaaacttgttgagtgccaagaagtgggataaaaatacaatgaaattgtttatttttcctatattaacgataggctaatattattttgcacctctggtcttactggtcttatgtttgagaacaaataagttttatctgaatattttatctctcgtgtgtgtgtgtgtgtgtgtgtgtgtgtgtgtgtgtgtttaatctctcatgtcctgtcaaaaattaagaaaaagaacagtttgattcagtcttcacacatctttcttaaacagttaaaggcaaaatcatcagagctacatggcccaaatattagcaggtaggttcatgtttgaattctcagagggtgattatgtagttcaattttaactccttcaacagacagactactatcgttgatgagcaaggagacaaaagtatttgataaacattatgtagttaatattatccttgagggaggggagaaggctgcctgtcttaggtaatgctttcgatggcaggtttgtcctaggcttgaggtagcaggcttgctcttttggctgaagaagccctaacatgcataccagtattgcaaatttacccacatgccaattgtatgctgtggaaagaaatgaataatgtagatcccattacagagaatgatgtggaacagatagacttaatgcatcagaaccagtgagcagtagacaagacatttagaaaataacaacagcagtgaaaacaaatataaacaaaccacaaacaaaaccattacatttgggtttctggttgcctgttacctcagagggttctggttacaagctaaaatgtcttgaccattaggaaggtcaagacaaggcccttaatgctgtgtaaaacagtaacaaacagtaagggtgacccagggagaaagggtaacaagttacattgaagttaaataccagggagaaagtgtagcagttacatggaaattaaataccagttacctgtgcagagactgaaaatacaaagcagacacaggaacggtagtagtagaaggcctagggcaagggattggcggggcgggggttggggggatggggcgggaatctgaatttgatctgaatttgttgcagcttgaaattgcagcttgaaactagccagccaactctaatgagggcattgatatgggaaaaacactacctcagaaaaaaaatctgacaacctaggtagagatcaaatggtaccatattctgaggatggaataataattcacacatggcttcacataaaatttgtgtgacaatggttatttactatgattcagtctgccatgacaattttaccagtaaaataactttctaggatttatttgatatcagttaataagcctaccttaaatgaataaccagaatatgacaattgaaaattaatgtaaaattacacaaatagttatgtgtctagatatttcacaatcaaatgtatgtgggcatttaatctagtcagatccaaataataaaaaattctttctttctagaccaacatttatcttgatattatacatacatatgtaaattacaaccacatatttgcatatgtaaattacacagcaatttacacatagatacatacatagctcactttttgttggtgaacacattttcctgaaggtttttttttttttttttttttttttttttgagatggagtctcgctctttcaccgaggctggagtgcagtggtgctatctcggctcactgcaagctccgcctcccgggttcatgccattctcctgcctcagcctcctgagtagctgggactacaggcgcccaccaccgcgcccggctaatttttttgtatttttagcagagacggggtttcaccacgttagccaggatggtctcgatctcctgacctcgtgatccgcctgcctcggcctcccaaagtgctgggattacaggcgtgagccaccgcacccagccgaaggtttttaaaataataattattctacctgtaatgccatagcagtattggtaaaaagttcaaatgtggctgggtggagtgcctcattcctgtaattctagcattttggaaggccaacacaggagcattacttgagtccagcactttgagagcagcctggaaaaccctatatgtacagaaaataaaaaaaaaataaaaaatagagtaagccaggtgtgggtggtgcatgtctgtatccctgctactcaggaggctgaggtataaggatcacttgaggagtttatcagtagtttgaggctgcagtaggctatgacctcaccactgcattgcaacctgggcaacagactgacaccctgtcttttaaaaagaattcaattgcatcatttatgtggacagatttgactggtgtcattctgttgctgaatcattccaaggtatgcacttaccttttctctcttgaaacagcttatgcaaaaacaaacaactaaatagagaagcagtttgcaaaactatatttaaaggtaaaccatactccctcacccccaactccacaaaaatagttttatgtagagaaaccacagatggtgcagcccccaaatctggagcatcctcaggtaccttggggtattctggagtgaaagactaaatctcagaggcttttggtcacacttgggtaggcatcctgattggctagtgaagaaacagctgtccctgctgtggtcagtttcagcctttcctggaagggaattttccagcattgggtgttcctgtagatgcttatagcaagttatgttcaatgaagccaactgcatcctgatttatctgttattcaatctgtgctgcataataaaaaaggtctgctttgaaaatgaaatcatgcactttgctttattttgcccatttgatatttcttctaatgttgtaagcttctcatgaattggcataagcagatatgttacaaattgatccatccaggacatccttgctagtcttagctcaccatagcaagtcagaatggaagacagttgcttctcctcccttcctctccccatcccacctcacatctgacatccttctcctctgaggaaaaataatcctctgttcaaatttaaaagcatggcctggtatgatggctcatgtctgtaatctcagcactttgagaagccaaggcgagcagatcactggaggtcaggtattcagtcagtgatacactctctatactaaaaatatgcaaattagccaggtgtggtgtcatgcacctgtagtcccatctacttgggaggctgaggcaggagacttgcttgcacctgggaggtagaggttacagtgggctaatatcatgccactggactccagcctaggcaacagagtgagtctctgaaaaaaagaaaaaaatatagaaaaatgttcaagtatttactgtccacatctttcagctatttaacacttcactgggattgtgaagtgaaatggagtgccattattaccttgttagccactttcaatttggaaaggtaaaaatgtccttcaatggctattgaactgcctgcactgaatttaaagtacagtttgttggaatattcgtgatgaagttgaaaaatagaattacagattattaggacttgaatgtacttgaggaatcatttgtattccctcatgtacacaaggaaatggagtcacagaaagtttcagggatttatccccatacttttaaacactgaaatgttcccaaaatgaaatgaaatacttccaattgttaacatatccgcttatgtcaattcatgacaagcttacaaaattagaagaaacatcaaatgggcaaaataatgtgaagtgcatgatttcattttcaaaacagacttttttattatgcagcagagatcgaataagagataaatcattttgatgaaaggaacaatgagagaaagcaaagaaagacatgtcctgcattaaaagctgcatttgatggtaactcattttgttttatgagttatgatgaatgcatcttagctgtttctaacctccctcccattccctatttttatttgtcagttaaagcacagcatttttccctttttttttgaagtgttaattaattgcatttgtttaatgcatcttgctgtgtctcaagcatggttaacaagggataatgccttttttcagggatgattccttcctttccttacggggctttgtctgtgatgggaactttgtgttttatttatttattttctttttaagagacagggtctaatcaggttgcacaggctggtctcaaactcctgggctcaagggatccttctgactgacctcttgaaacattgggattacaggcgtgagccaccgcacttggctctatctttctgcaaaaacctagcaattctaattctctctccatctatgtctagaccagggagatataatcaagagaaaagaaacaactaccttcattagattaagagtcaaaagggcctacaggcaaaaagactccaggaccctcttgagtgagcctgtgcattgaaatcttcagcttcatagagacacagaagtccaaataggaagttggatttgccctattttcttagcctcttctagtctgtgaccgtttcttagtctttccttgtttttcatgaccttaatagttttttggtattaatattatggagaatgtccaccacctggggtctgtctgatgttttagacagggatatgtgttttggggaggaaatctgcagagatgaatcaatcatttatatcactatgggcacatggatgttttggatatgctttaggttttaattcaacactacactactgtgacttgctctactttatattctttgtggccatgatgagacactaaaacatctattcacttgaatagcaagtaaatgagaggactcaatggcaaatgactgttatgctttaacatatccagttctttgtatattttttgacatttaggttattttaatgcctttgctcctctaaggtatttccttcttcttttttttttttttttgctccacacccctccctcctctaacttgtttccaaattcttccttgtaaattgtgcattcctcattctaggggcattacttattttcttttgcttgcttcaaaaaacactctgcattggtctgtacacattttccctcttatatcctttctgtaagcatttgtattcagttgaaatcttatggaatactttaccacagaaaatttctggtgtataccaaaaaagggaatgaaaatagaataatggatcccatttgcccatcatttgcttcagcaattataaatgcatagcataatctttagtatttaacctcatttatgtttccattcttattatggcatgatgcaatttatttaaagatagtttggtgagaaccattcactcccctggaaaggaggctgaagcccaaaagtcaaagtggtgtggctcggtgggtcccatccccactgagtccggcaagccaagatccactggcttgaaatctcgctgccagcacagcagtcttaggtcaacctgggacactccagcttggtgtgtgtgtgtgtgtgtgtgtgtggtgggggggcggggggggcacatccaccattgccaaggcttgagttggcagttttacccccacagttgtaaagaaagccgcctggcagttcaaactggtcagagctctccacagctcatcaaggccactgtggcaagactgcccctctagattcttcttctctggtcagggcatctctaaaaaaaaggcagcagctcagtcaggcacatatagttaaaacccctatctccctgggacagagcaactgggggaaagggcagctgtgggtgcagcttcagcagacttaaacgtccctccctgatggctctgaagagagcaaaggatctcccagcacagtgttcaagctctgctaagggtcagactgcctcctcaaatgggtctctgaaacttgtgtatcctgactgggacacaccacccagcgggggccaacggacacctcatacaggagagctcttgctggcatctggctggtgcccctctgggacaaaacttttagaggaaggagcaggcagcaatctttgctgctctgcagcctccactggtgataccaaggcaaacagggtgtgggatgaacctggagcaatctccagcagaactgcagcagaggggcctgttagaatgagaactaacaaacagaaaggaatagcacatccactcagaggccccatctgaaggtcaccaacatcaaaaaacaaaggtagatgaatccatgaagatggagagaaaccagtgtaaaaggctgaaaattccaaaaaccagaatgcctctcctcctccaaaggatcacaactcctcacaagcaagggaacaaaactggatggagaatgagtttgatgaattgacagaagtgggcttcagaacgtgggtaatagcaaattcctctgagctaaagaagcatgttctaacccaatgccaggaagctaagaaccttgaagaaaggttagatgaatttctaactagaataaccagattagagaagaacataaatgacctgatggagctgaaaaacacagcatgagaacttcatgaagcttacacaaatatcaatagctgaattgatcaagtggaagaaaggatatcagagactgaagatcaactcaatgaaataaagcaagaagataagattagagaaaaaagaatgaaaagcaacgaacaaagcctccaagaaatgtgggactttgtgaaaagaccaaatttaagttgaagtggtgtacctgaaagtgacggggagaatggaaccaagttgaaaaacactcttcaggatgttatcaaggagaacttccccaacctagcaaggcaagccaacattaaaattcaggatatacagacaacaccacaaagatacttctccagaagagcaacaccaagatacataatcatcagattcacaaaggttgaaatgaaggaaaaaatgttatgggcagccagagagaaaggtcatgttacccacaaagggaagcctgtaaggctaatagcacatctctcttcagaaacactgcaagccagaagagagtgggggccagtattcaacattcttaaagaaaagaattttcaacccagaatttcatatctagccaaactaagcttcataagggaaggagaaatacaatcctttacagacaagcaaatgctgagagattttgtcactatcaggcctgcgttactggtgctcctgaaggaatcagtaaatatggaaagaacaactggtaccagtcactgcaaaaacatatcaaattgtaaagaccattgacactatgaagaaactgcatcaaataatgtgcaaaataaccagctagcatcataataacaggatcaaattcatacataacaatattaaccttaaatgtaaatgggctaaaagctccaatcaaaaggcacagactggcaaataggctaaagcgttaacactcattggtgagctctattcaggagactcatctcatgcaaagacatacataggcccaaagtaaagggatggaggaatatttaccaagcaaatggaaagcaaaataaaaaagcaggggttgcaatcctagtctctgataaaactcactttaaatcaacaaagatctagagactaggacattacataatggtaaagggatcaatgcaagaagaagagctaactatcctaaatacatatgcccctagtacaggagcacacagattcataaaacaagttcttagagacctacaatgagacttagaatgccacacagtaatagtgggagactttaacaccccactgtcaatattagactgaacaatgagacagaaaattagcaaggatattcaggacttgaactccgctctggatcaagttagatcaagtggacctaacagacatctatagaagtctacatctcaaatcaacagaatatacattcctctcagcacttcatctcaattcttctaaaattgaccacataattggaagcaaagcactcctcagcaaatgcaaatgaatggaagtcataacaaacagtctctcagactgcagtgcaatcaaattagaactcaggattataaatcattctactataaagacacatgcacacatatatgtattgcggcactattcacaatagcacaggcttggaaccaacccaaatgcccatcagtgatagactagataaagaaaatgtggcacatgtacaccatagaatactacacagccataaaaaggatgagttcatgtcctttgcagggacttgggtgaagccggaagccatcattcttagcaaactaacaaagggacagaaaaccaaacaccacatgttcccactcataagtgcaagttgaacaatgagaacacatggacacagggaggggaacatcacataccagggcctgtggtgggggtggggggcaaggatactattaagagaaatacctcatctagatgactagatgacgagctaatggatgcagcaaaccactatgtcatgtatatacctatgtaacaaacctgcacgttctgcatatgtaccccagaatgtagagtatacataaaaaagatctttcagtacattgctgtaaaatataggaaccattttattttatttagctgcagaatcttttccatgcctaaaattatcaacaataattcctctatgtcaccaactatcaaattataaatgtcaaaataatattttcatagtttgctaactcacacaaggtctatgcactacaatcagttgatttgtcttttacatttcttttaactgatatagatttcttatccttttatgcacattcttgttggaaaaaactgctctttttactctacatgaaaatgggttttagagtcggaaaatttagctgtcaagttattttagaaggaacgtgagtattttccataatgctcagtcttaggttaccaactccttaggagcaaatgctgtgtgacttggtagtgatctacccagaaggaatgctgctgggtaaatttggccagcttgtgtgacagctctttggactcactatgtctcagtttcatctacttttaacagtgttttattttgaagatagtttctgactctgtcacccatgctggagtgcagtgatgcaatcatagctcgatgcagccttgaacttctgggctctagaagtcttcccacatcagcctcatattatctagtacctggcagagatacagatctgatgagaaacaaagataaaggggtgtcagaaggtagcttttgctgcatcatcagacacgcacacatgcgcacacacacgtgcatgcatacacacatgtgtacgcacacacaatcaactgcaattttttcctctttaccaacccacagttagctgaaattatcattagggtatttctaggttatatgtgcacacacaacctacttaagttctgagctcaatattctgttttattctttcctgttcagaagccagcatccatagctctgggtctcattatttgctttttgtcgtccagttgtgctctactgatttaaaagttatctttacattttcagtttcccagtcaattcaagccaaagcatatttattgggcatctaccatgtgctatggactgtgagagacttaaagattaataacaacaaccataaaaactcattgatatgctgggcattatttctctccccatggcctccaaatgcttggcccataattcaaaacactacagcaacttgaaggcagcagattgtttctcatttcagggatccacaggtttatgccttctcaaacaaaggtctggtaattccaggctgcatgcagctattcttcctttaaagactgagaaaccatgcatacaacatcttttcttccttcttcgtttatacaattgataattacatattgacatcttactttgagaaagtcgtcatactggataccgtcagtcatagaaacagagataagattcaacctctgatcccaaggaaggcagactcttagtaaggaagtcaaaacaataaatgaaaatgcccatactgcaaggcatgcacatcatacattccataagtgggtaaaaacatgccttggcagcacagaatcttgctttccatttgtgtcattgaggacagtgcattagttatctattgctgcataaaaaattcctctaaactttaggttaaaaccgcaaacatttttttttcctcgtgcaattttcttttttttttttttattatactttaagttttagggtacatttgcacattgtgcaggttagttacatatgtatacatgtgccatgctggtgcactgcacccactaactcctcatctagcattaggtatatctcccgatgctatccctcccccttccccccaccccacaacagtccccagagtgtgatattccccttcctgtgtacatgtgatctcactgttcaattcccacctatgagtgagaatatgcggtgtttggttttttgttcttgcgatagtttactgagaatgatgatttccaatttcatccatgtcgctacaaaggacatgaactcatcgttttttatggctgcatagtattccatggtgtatatgtgccacagtttcttaatccagtctatcattgttggacatttgggttggttccaagtctttgctattgtgaataatgccacaataaacatacctgtgcatgtgtctttatagcagcatgatttatagtcctttgggtatatacccagtaatgagatggctgggtcgaatggtatttccagttctagatccctgaggaatcaccacactgacttccacaatggttgaactagtttacagtcccaccaacagtgtaaaagtgttcctatttctccacatcctctccagcacctgttgtttcctgactttttaatgattgccattctatctggtgtgagatgttatctcattgtggttttgatttgcatttctctgatggccagtgatgatgagcattttttcatgtgttttttggctgcataaatgtcttcttttgagaagtgtctgttcgtgtccttcgcccactttttgatggggttgtttgtttttttcttgtcaatttgtttgagttcattgtagattcggatattagccctttgtcagatgagtaggttgcaaaaattttctcccattttgtaggttgcctgttcactctgatggtagtttctttggctgtgcagaagttctttcgtttaattagatcccatttgtcaattttggcttttgttcccattgttttcagtgttttagacatgaagtccttgagcctatgtactgaatggtatggcctaggatttcttctagggtttttatggttttaggtctaacatttaggtctttaatccatcttgaattaatttttgtataaggtataaggaagggatctaatttcagctttctacatatggctagccagttttcccagcaccatttattaaatagggaatcctttccccttttcttgtgtttgtcaggtttgtcaaagatcagatagttgtatatatgcggcattatttctgacggctctgttctgttccattggtttatatctctgttttggtaccagtaccatgctgttttggttactgtagccttgtagtatagtttgaagtcaggtagcatgatgtctgcagctttgttcttttggcttaggattgactaggcaatgcagggtcttttttggttccatatgaactttaaagtagttttttccaactctgtgaagaaagtcattggtagcttgatggggatggcattgaatctataaattaccttggacagtatggccattttcacgatattgattcttcctacccatgagcatggaatgttcttccatttgtttatatcctcttttatttcattgagcagtggtttgtagttctccttgaagaggtcattcacatcccttgtaagttggattcctaggtattttattctctttgaagctattgtgaatgggagttcattcatgatttggctctctgtttgtctgttattggtataagaatgcttttgatttttgcacagtgattttgtatcctgagacattgctgaagttgcctatgagtttaaggagattttgggctgaggatgatggcgttttctagatatacaatcatgtcatctgcaaacaggaacaatttgacttcctcttttcctaatcggataccttttatttccttctcctgcctaattgccctggccaggacttccaacactatgttcagtaggagtgatgagagagggcatcccagtcttgtgccagtttccaaagggaatgcttccagtttttgcccattcagtatgatattggctgtgggtttgtcatagatatctcttattattttgagataggtcccatcaacacctaatttattgagagtttttagcgtgaagagttgttgaattttgtcaaaggctttttctgcatctattgagataatcgtgtggtttttgtctttggctttaaaactgcaaacatttattatctcatacatttctgttcttcagggattcaggagcaatgtagctggccagttctagctcaggatctctcatcattttgtaatgaaattgtagacagggcttgcagttttatgatggtgtgagagaatctcacttatgtgtgctgggcaggaggcttcagttcttggccacattggcttctccctagggctatacatgagaccttaacagctggcttttctgaaagtgaggagagaaagaaggaggctaaaagggagtctaatatgaaagccacacactcttagaacttgatcttggaggtgacaccttgtcgcttttgcactagatttggaggtgaaaccttgtaaccccagaaggtgttaattgtaggtgtcaattggccatcttggaagctagactatcacagaagctcttccaaaggaggtagcttaggagctgcatagaattttgtcataaggacaaaggagaaactgtgaacaaacacataggtacagcaagtgttgaggatgggctgtgttgtgttcagtgttatcttaagggttgagcttctgtgatgaaattgaaatcagatcatttcaggtggtgcaacttgctggtaagccatggatgttattctgtaggcaatggatgaatcatagcaggactttgcagaattattaaagaatatcagtttcatgatagtagaggttgggatagaatacagaagattagtggtgcgagttgagatctacttatagattcaactgggttagagattgaggaaatggggaaggaatgaggctctgcagaggcattggaaggatgatactgatagaaatttgcaaaccgttagaggccaagacaagaaataaccatccaaagttgcagttataggtaaaactgtccaattaagaaaagagaaagagttcagaggtgggtgaaggtcaagattattagatgctttggagatccttgggactgacggatatgttatttattattttcttggtgattataaggtaattaatagaaatttagagattattgtttttccatattttcttgtttggaggcattttttttaacctgaaattggcatttccttttttacctgaaacatatccattatccagacagtttcagtgaggcacggtggccaaagtaggaggatgacttgagttcaggagttggagaccagcctgggcaacatggcaaaatgcatctctacaaaaaatataaaaattacccaggcatgacagtgtacacctgtagttccagctgtgtggtaggctgagattggaggatcagttgagcctggaatgcagaggctgcagtgatcccagatcatgctattacactccagcttgggtgacagagcaagaccctgtgtcaaaacagaacaaaacaaacaacacacaaaacaaaacacaaaacacaaaaacaaaaacaataaaactttcttaaccattctaacctaattataattctaagacctatctgtgtcctgacctcaagagcaggtacaattattgaaaaacatttctttaattattcccagttctcttacacctttttttttctcacaataggcagcatcccctcagttgtccagctgaccactggaagggctgatacctcaggaaacacataccctgctaggagattctccataggccctgacttgtttattgccctgctttaggtagctttctccttcctcacattctgttctcctaattttcttccactgcctaataattgaactgacttttctgactgtctgttcctcctgcctttgcagttattgtaactccataaatgccacccttgagtcacttctcttccttccttcctactgtctctcttactggcctatgtagccttgcatctactcatggtttgatgataatttcctttggagagaccccaggggcctatacgttctgccctcacttcccctccaagtttcttcctgcccttatagctcccctttgaacaacattgcctatatgttctgcccaaaactcaattcagtgttcccaaaattgtctcgtcatcttcccaagcttacccggctccctgctcatagcatctcctctcagtcccttatcttgggtttgaatcccctctctttcccatccccaatgtaaatcactttcagaaataacagttacttccatttcttcttctgtgatacatctctaatttccttggtcatatgctccctttttctgttactattttaatcatatcctgtctatgacttgtacactctctaatctatttttaaagctattcttcatcttcctatataattgattgtgtaagactatctcattcaaaattcatcaacaagtgtccactgtgctacacgacctgccccatctccatcgtcacaacgacagtcatcatttctttcctctggatggtatacttcatcttccatccaacctgagtttacctaggaatcactgcatttcacccttggtttcttgctttttctcattcttttcaggctctcttcaacttggaatactgctactattccatctccacacaatttattcattactgagggctaaaatgctgtttcttgcacttctctcccagtttcctcgttctgcagaactaatttactgattcctctctcatcagggacagttcctttccaaaatcctacaacgtgggtccatgaaatcagctagagaaaaagagggacaggatggaggctaggattatcatgggcactgacatactggcctctgggggtaggaagactaatactccctaggaaggaaggaaaagaaccttggagaggactgttttatctcagtatttcccagaagctccaacagtggagacttccctgggaccttcaccccatctgctcctaatgagcttcctgcctgtggggctccactcagaacgttacatccggtgatgcataggacaccatttgcagaaatgtgtgcatgcgtcctggcgtgtgcgtgcttcctggcgtgtgcgtgcttcctggcgtgtgcgtgcttcctggcatgtaagtgcatgtgcacatgtggcatttactgagcatgcatgcattgatgtgagaatgtattttcttcctttccacgatgaactgccacagaatggttaaagtttttcagggctgaaaaggttgttttagcttgaatatgcacaaatatgtttttattgcagcaactatttaaaatagctctgaaagccattattttccccattccttcttccccccaaaatttgactctttatccaattttccattctgtgtcttttaattggggcatttagcctgtttacatttaaggttattattgttatgtgtgatttgatcctgtcattattatgttagctggttattttgcacattagttgatacagtttcttcatagcaaccttggtctttaccatttggtatgttttggcagtggctggtgccggttgttccttccgtatttagtccttccttcaggagctcctgtaaggcaggcctatgttgacaaaatccctcagcctttgcttgtccataaaggattttatttctcctttgcatatgaagcttagctttgctggatatgaaattctgggttgaaaatccttttctctaaaaatgttgaatattggcctccactctctttttgattgtagggtttctgcagaaagatccactgttagtctgatgggcttctctttatgggtaacccgagctttctctctggctgcccttaacatctttccttcatttcaacctttgtgaatgactattatgtatcttggggttgcttttctcgaggagtatctttgtggtgttccttatatttcctgaatgtgaatgttgacctgttttgctaggttgggggagttctcctggataatatcctgaagagtgttttccagcttggttccattcttcctataactttcagatataccagtcaaacataggtttgctctttttacatagtcctgtctcacgtgcagaaatacacatacactcaaaataaagggatggaggactatttagcaagcaaatggaaagaaaagaaaggagggctttcaatcctagtctctgataaaacagactttaaccaacaaagatcaaagaagacaaagaagggcattacataatggtaaagggatcaatgcaacaagaatagctaactgtcttaaatatatatgcgcccaacataggagcatctagattcataaagcaagttcttacacctacaaagagacctagactcccacacaataatagtgggagattttaacatcccactgtcaatattagacagatcaatgagacagaaaacaaggatatcaggacttgaactcaactctggatgaagtggacataatagacctctacagaactttccaccctaaatcaacaaaatatacattcttctcagcaccacatcacacttattctaaaatggaccatataattggaagtaaaaaactcctcagaaaatacaaaagaatgtaaatcataacaaacagcctgtcagacacacgtgtgatcaaattagactcaagattaagaaacttactcaaaactgcacaactacgtggaaactgaacaacctgctcctgattgactactgggtaaataatgaaatgaagtcagaaataaagaagttctttgaaatcactgagaacaaacacacaacatattagatctctgggacccagccaaagcagtgtttaggtggaaatttataacactaaatgcccacaggagaaaatgggagaagatctaaaaccgacacactaacatcacagttgaaagaactggaaaaacaagagcaaacaaattgcaaagctagcagtaaacaagaaacaactaagattgtagcagagcagaaggaaagagatacagaaaaacccttcaaaaaatcagtgaatccaggagctggttttctgaagattaataaaataggtggaccactagcaagactactaaagaagaaattcagaagaataaaatagacacaacaaaaaattatacatggcgtatcaccactgatcccacagaaacacaggtaccatcagagaatactataaacatctctatggaaataaacaaggaaatctagaagaaatggataaattcctggacacatacatcttcccaggactaaaccaggaagaagtcaaatctctgaatagaccaataacaagttctgaatttgatgctgtaattaatagcctatcaactaaaaaaagcacaggaccagaaggattcacagctgaattccaccagaggtacaaagaatagctggtaccattccttttgaaactattcacaacaacagaaaaagagggaaccctccctaactcattttatgaggctggcatcatcctgataccacaacctggcagagacacaacagaaaaataaaatttcagacaaatatccctgatgaacattggtgtgaaatttttcaataaaatactggcaaagagaatccagcagcacatcaaaaagtttatataccacgattgagtcgacttcatcaatgggatggaagtctgaatcaatatatgaaaatcaataaatgctgtccatcacataaacagaaccaatgacaaaaccacacatgattatctcaatgcagaaaaggcctttgaaaaaattcaatactccttcaagctaaaaatcctcaataaactaggtattaatggaacgtatctctaataagagctatttatgacaaagccatagtcaatatcatactcagtgggcaaaagctggaagcattccctttgaaaactggcacaagacaaggatgccctctgtcaccactcctattcaacatagtattggaagttctggccagggcaatcaggcaagagaaagaaatagagtatattgaagtaggaagagaggaagtcaaattgtctctgtttgcagatgacatgaatgtatatttagtaagctccattgtctcagccccaaaattcccttaagctgataagcaactttagcaaagtctcaggattcaaaatcaagctagaaaaatcacatgcattcctataccccagtaatagacaaacagagagccatatcatgagtgaacttccattcacaattgctacaaagagaataaaatgcctaggaatacaacttaaaagggatgtgaaggacctctccaaggagagctacaaaccactgttcaaggaaataagagaggacacaaacaaatggaagaacattccatactcatggatttgaagaatcaatattgtgaaaatggcaataatgccccaagtaatttatagaatcaatgctatccccatcaagctaccatgactttcttcacagaattagaaaaaactaccttaaatttcatatggaaccaaaaaagagcttgtgtagccaagaccatcctaagcaaaaataacaaagttggaggcatcaagctacctgacttcaaactatgctacaaggccccagtaaccaaagcatggtactggtaccaaaactgtgtgtgtgtgtgtgtgtgtgtgtgtgtgtgtgtaaaaaatatataaattttcaatatgtaaatatataaatacataaatatattatattatattaatgtgtaaatatatattcatatataaaaatatataaatatataaatttgtagatatataaattctgacatttaggtttccttcttcttaggaattccaccaaaattacacgagtaacactatactaaatttttacctactatcattaaaaaataatgacttactcaaagctctgacactcattagagcaggttgatatggtagaaaattctagccctatgcaactggagtgatcttgatgctaagacaatatgacccaaaaccttgtcctttccttttggctatatgaatattttctaacttttgtgaacaaaatatgtctcattttcctcatgatggtgtttcaaaatgaattgatgggtgtttttcagttattagtggataggagctctcttagctcagcccttcaaaaacttgtgtttgatgttgtaattttgtaaattatctcaatgtatgcctatatgcttacacacataatcccctacctaaaagatcaaccttagcttagaatttcttcctttttatttttttcctctatttttttttttttttttttttttttgagacagggtcttgttctgttgctcaggttggggtgtaggagtacaatcatagctcactgcagcttttgagctcctgggctcaggcgatcttcccacctcacacttcagcctcccctgagagcacaggcatgtaccaccacacccagttgatttaaaatctatttttttgtacagatgcagttcctatgttattcaggctggtctcgaacttctggcctctagtagtcctcctgcttcaacctcctcagagtacaggcatgaaccatcattcctggccccttactatttctatattttacttttagtataagtctgtgaaagaagtatatttctcatagtttgttgaactgcgcagatgatgatgttgaaggatctgcacgatggttatgatggttgctgtcattgcactacagtgctttttaaaaaactgaaaatattcatttctcactagaatagtcatacaggcatttatttgttgctttagaatttggaaacttctttttatattcatagttgtatttcattctgccagcagattaggcagattcatcctctcccactttccagtggtagaaacaggtgtcctgaggcagtgaagtagttgttggaaaatcactgtggtttgctttccagggattttcttgtcctctgagtgcgaaagtatcataatacatggcacattcccacaggaagtttagggtgtgaaaagtcaatgtattaatatacatatgggatccacttccactcaaagcaaaacacattgagtcaagtatcagagctcagtgggtgtacatgatggcatttaattttcctaaattacttcatataattaatatacactaagcctttgttatgatgctacacatcatttttggagtcacaagctttcaaccttcatctaactaaaagatggatatcttcattttatattaggtggtctggaagccatagtagtgttaaagagcacatagggaatgttttagtccattcggattgctgtaaggaaatacaatagactgtgtggcttataaataacagacatttattgctgagttctggaggctgggaattcaagatcaaggtgtggcagattcagtgtctggtgaggacacacatctttgtttgttgatagtgccttttccttgtatcctcatgtggtggaagggataagggagttctctgagttcccttttgtaagggcaccagtcccattcataaggctccaacctcatgacttcatcacctcccaagggcctcacctcctgatactatcatcttgggggtcatgatttcaacataggaatttggagtgacacaaccattcagatcatagcagagagagtgagatgagacttgccgaactccataaagccatatgaatattttcagttccagtcctatttccattttcaaatgttgagttatgaacttgattgatgcctcctggtatttttcaaaatgttctagagctctcatgatcaatattaaacctttcccattcaaaggacatgattattttatgtgagtaatgtgttgctatttgacaaaggagtacaactataaataaatcttgactatcttgatgtaggaaataaatacacctgtcaagatatactataatgcttttgtagtcaaaacaatgatggggctagcattgtgactcatgcttgtaatcccagcactttgggaggccgagggaggtggatgacttgaggtcaggagttcgagactagcctgtcctacatggttaaaccgcatctctactaaaaatacaaaaatcagccaggcatgatggtgcatgcctgtaatccctgatactctggaggctgaggaaagagaatcacttcactccaggatgcaggggttacagtgagccaagacggtgtcactgcactctagctaggcaccagagtgagactcgatctcaaaaacaaacaaagaaaaaatggtggatagaataggatattatttaaatgaaaactgtaaggggagttgtatgctctcaaatgtcattatgcacagtctaatatgtccctttcactctgccactctacctgctaatttgcttccttaattcagacttacctattaggttattagttataatataggttgacaattatgcagcttttcttctttaccaagacctgttccaagtgctttttatattaactcattggtgtcaaccactctaccccatagtaaccattagtattagtttcctatctgtgctgtggtaacaagttactacagacctagtggcttcatacagttctaccactcagaagtccaaaatgagacttaggaggctaaaatcaaggtatcatcaggacttcattatttttggaagctctgcgagaggatacatctccctaccttttcaagattctagaaacttcctactttcgttggctcataggctcctttctccaccttcaatgccagtagactgagtccttgttctgtcatctttttgtttgtccctctttttcccttttctatgggcacagtggataacctggaatgatctcccaatttcaaggtctgctgactgggaatcttaattccacctgcctctttcattcaaatcccttttccatgtaagaccacacaaccgcgcatattaacacatgggcatctcagggggaccattattatgcagaccacacagttgttatcttcattttatagccaagaaagacaaacagagttaaatcacttactcagattgttggtctgctaaatggtagagctagttaaaattaggagcatacgcagggaagctaggcagtgttgtgatcaaggcccttggccccctaaagtttcaatgaaaaatcatggagataatcagtgactattactgtccactcaaccgggttgcacagagggagagagagaccaggagcctggctggctgatgataatgtcttaccctattgctagcagtgttggttcctgggttctctgcactgtggctttcaaaagaacagagcagctttggtgaccccacttgttgtgccataactgtagaggccaaggctttttatcccctaaagttttactgaaaaattactgactaggcagaccaatttacaggtgaaatgacatacaaacatgcttaatgcagatacaaaggagccttcagaatgaagacgcaacctccctgtgagatcctgaagcttatataccaacctgagtttacagaaagagtgggggcttggatcccagtaatacagatgatgggagggggagaagaggaattctgtcgaggagattactagaacggagattaacttgtaaataactctttttgaaaattaaataatccttgaggacaaccttggaaaactgtctgttgaggtgtggtgtcatcttggtttttttctgcagtcgataaggatataacaggaaggggttaaaaacaattattatccttgtgggagtctgtgtcttaggcaaataaagaaacttcagctactttgggagaggtagtgggagagggggaggttggacttcttcaactcagcctgtcaaaatgccatattttggggtattgttttctgagcctcagcaggactcatacagtattgtgggatttggggctgagccatggtgggacagattttcccctgagatccttatgcatccaaatcagtaggtgcctgttcacgttcaacatgaaaaaactgacacaaagcaatgagtaggaaattggggggtaaatgtaatgaaacaaacgtgtgttaaacaacatttctccataatattaaactaatgtgaagaatttagagtcaggaatttttctggaaagtgtaggctccaacttcctcagagtatgatttgtaggatgctcttccccattcactactccacccaacatttctgacagttatcagaagaaagagacctggtataattaatcaaactcaagacatttaggtcattgtttgcttgagattcatcaggaggtcttctaaccatgctgcaaacactttaactcatcagggcttcacagatgaatttactgattccacaaacttgtaaattgtatttccagagccaatgtgaactctctcagttatggtttttgtcttgaagactgtgactttcatttaaaatgttgtttcaatgatgcattttctgaactcaatgaaattatgaagggacagattttaaagtccataacgattttgttttattaaagctgccaaatatttttaatatggtgtgaagaggcacaagaaaatgtaaaccctagttaccactgagacgtcccattgtttagtcatttcagcaccactgcatagacttccgtaatatgagaaagagacttaatatcctagtcatgaggagcacagggtttagggaaaaatacatacacagatatatctatatgttgatatacacacacacatatacatgcacacacactcacacatacacaatcagtgacttcttatgatggttcaactaatgattttcaaccttatgatggtgtgaaggcaatacacattgtagatgtccacaaaatatttaaaaagctttattctgagccaaataccagtgacctaggcctgtgacacagccccaagagatccggagaacatgtgcctaagggggttgagcatgattttatacattttgtaggggagagaagttacaggcagatattcatcaattcaaggtatacatttgtttcttccaggaaggtggcacaacttgaagcagaggattcccggttatagacagattcagaggttttcaaattggctattggttgaaggagttaagttacctaaagacctggaatcaatagaaaggagtgtctgggttaagaaaaggtgttgtggagaccaaggtcttatgcagataaagtctcatagttggccatccttagaagcaatagatgacaaaagtttcccattcagacccttgaaagatgctagatgctcatctaatcacatcaagatgagcaaaagaccagtcaagggaagtaaacctgaaaaacttgttcacaccactttatccctccttggattagatagtgtttgcctcatggttagaagatctcctgatgaatcttgagcaaacaatgccctaaatgtcttgagtttgattaattatcccaggtctctttcttctgacaattcaggtaaagagtagaatgcagctcttccttataaaaggcagctttgtgaggccatttcaaaatatatgaaagaagtatattttggggtaaaatgctttgatttcttttagggcctggtatctatcatgtgatgttacaccagagaggttgaaatttggtatctttttgttatcaagtgtctgtttggttggtcttatgatttctgttttaatgttaattctggtcagttgtgcccgagttccaaagagagaagtgtatagtgaggcatgtccaatccccatatcccctcatcgccagaagaagtttttcaggattagtttggaatgcccttggcagagagggtttatattcagttaactggggacttagaattttaattttggtttacagaattcactagagactctacatccagtacccatataatcattctaatttgcacttttggtacaggattcaataaattacatgagatgctcaacactttattataaaatagactttctgttagatgcttttacccaactgtaggctaaagtaagtgtactgcacatatttgaaatagactaggctatgttgcatgatatatttggtctatgtgataaatttttgtcttatgatattttgaacatatcatgggtttttcagatgtaatcgccattgcagttccaggaacatctgtatgtattttatgtgtgtgtgtgtatgtctgtgtgtgtttgtgtgtgtgtatgtgtgttcttcaactccttggacagatctcaacctttcagaggcttcgttttcttctttgtaaaatgggaacagtggtatttctcttatggaatgtcattgtggagtaatttagaaaagcgtagcattcaaccggaaaccttcatagcatttattgcctggaaaatgatgttgatttctaggggagataagtactttcttatttatcacatttcataaaaggaaggaacctacttttcttgaattctaaaacacatatgtgcattgggaatgggaatgagaatacacttagcaaaatgatccctctgaagacaatggcaatgtgtttgccaaggggattaattagacgtattttgcaatactgtttatagaatggaaaacaagaaattgagaggaggtagttggaagtgtgcacttctctgcagatcagccaactggcctcagtactttaggtaagggattttaatttgtcctttggtttacaggacaacgcagacttactgctgtttatattcatcaaacacacatacctgagtagcagatctctactctccctttaaataaggtaattctatggaacatttttgaaagcctagaaaaatgtaatacagaggtgatgtgaaagaaaattacatctattgtcctgttatcccttgactttctctggatataaatgttttccacatttttgcaacctttctctgcctaagctttcattttggggaaaacataacagtgtatgattttctgtgtgtttaattctaaaattgcaaagttaatcccacaccattgtggagataaacttttgagtttctgtttgaaaatttggggatatggaaattgtcaaatactgctgatatatatgtttaagagacccaggggcatgaaaacatctggatttttaaatatattgtctggtaatcatataatacatcgtcctacattgagaggtaactgtttattaatcatagtttctcttctatattttattattatactttaggttctgggttacatgtgcagaacgtgcactttgtaataagtatacatgtgccctggtggtttgctgcacccatcagtccattacctacattaagtatttctcctaatgttatccctcccttaggccctacccattgacaggccccagtatgtgatgttcccctccctgtctccatgtattctcattgttcagctcccactaatgagtaagaacatgtgttgtttggttttctgttcttgtgatagtttgctgagaatgatggtttccagcttcatccatgtccttgcaaaggacataaactcatccttttttatgtattccatggtgtatatgtgccatattttcttaattcagtctatcattgatggacatttgggttgtttccaagtatttgctattgtgaatagtgcctcaataaacatacgtatgcatgtgtctttattgtagaatgatttataatctttggatatatgcccagtaatgggatttctgggtcaaatggtatttccagttctagatacttgaggaatcaccacaccctcttccgcaatggttgaactaatttatacttccaccaacagtgtaaaagtgttcttatttttccgtaatgtctccggcatctattgtttcctgactttttaatgactgccattctaactggcgtgagatggtatcttattttggttttgatttgcatttctctaatgaccagtgatgatgactattatttcatatgtctgttggctacataaatgtcatcctttgataactctctgttcatatactttgaccatttttttgatggggtttcttttattcttatcaatttgtttaagtgctttgtagattctggatattagccctttgtcagatggatagatttcaaaaattctctcccattctctaggttggctgttcactttgatgatagtttcttttgctgtgcagaagctctttagtttatttacatcccatttgtcaatttgacttttgttgccattgcttgtggggttttggacatgaagtctttgcccatgcctatgtcctgaatggtattgcccaggttttctttcaggaattttatggtcctaggtcttacatttaaatctttgatccattttgatttgatttttgtaaaagatgtaagaaaggggtccagtttcagttttctgcatagctggccagttttcccaacaccatttattaaatagggagtcttttccccaccacttgtgtgtgacagctttgtcaaagatcagatggttgtacctgaggcctccattcttttccattggtctatatatctgttttggtacccataccatgctgatttgtttactgtagccttgtagtatagtttgaagtcagttagcatgatgcctctatctttgttcttcttgctcaggattgtctggacaatctggccccttttttggttccatatgaagtttaaagtacctttttccaagtctgtgaaaaagacagtggtagcttgatggggatagcatttaagaaattactttgggcagtttgaccattttcaatatattgattcttcctatcctttagcatggaatgcttttccatttgtttctgtcctctcttatttccttgaacagtggtttatagttatctttgaagaggtccttcacatcccttggaagttgtattcctaggtattttattctctttttcacaattgtgaatgggagttcactcatgatttggctctctgtttttctgttatcggtgtataggaatagttgtgatttttgcacaggattttgtatcctgagactttgctgaagttgcttattagcttagggaggttttgagctgagacgatgtggttttctaaataaacaatcatgtctgtgcaaacagagacaatctgactccctcttttcaaagttgaatactctttatttctttctcttgcctgattgccctggccagaatttccaatactatgttgaacagaagtggtgagagagggcatccttctcttgtgacggttttcaaagggaatgcttccagcttttgcccttcagtatgatattggctgcaggtttttcataagtagctttaattatttagagatatgtttcatctttacttagtttattgagagtttttagcatgaagtatgttgacttttttgaagcctttttctgcatctattgagataatctcatggtttttgtcattggctctgtttatgtgatggattatgttattgatttccatatgttgaattagccttgcatcccagggatgaaaccatctcaatcgtattggataagctttttgatgtgctgctggattctgtttaccagtattttattgaggagtttcacattgatgttcatcagggatattggtctgaaagtttatttgtctgaagtgtctgtgccaggttttggtatcaagatgatgctggcctcataaaatgagttagggaggattccttctttttctgctgtttggaatagtttccaaaggaatggcaccagcttctctttgtacctctggtagaactgggctgtgaatatgcctggtccttttttatttgttggtaggctatttattactgcctcagtttcagaacttgttattggtctattcagggattcaacttcttcctggcttagactttggagggtatatgtgtccaggaatttattcatttcttatagaattactagtttatttgcatagaggtgcttataatattctctgatggtagtttgtatttctgtgggattactggtgatatcccctatgtcatattttattgagtctgtttgattcttctctcttttcttctttattaatctggctattggtctatctattttgttgatcttttcaaaaaaaccagctactggattcattaatcttttgaaggatttttcatgtctcgatctccttcagttctgctctcatagcagttatttcatgtcttctgctagctttggaatttgtttgctcttgcttctctagttgttttaattttgatgatagggtgtcagttttatatcttttctgctttctcttctggacattaagtgctataaatttccctgtgaacactgctttaaatgtaccccaaacattctggtacgttatgtcttgtttctcattggtttccaagaacatctttatttctgccttcatttctcgagaggggggccgaagccagggagctaagtggtctggatcggtgggtcccaacctgatagagcccaggaaactaagattcactagcttgaaattcttgctgccagaacagcagcaatctgagatccacctgggacagtggagcttagttggggagaggagtccaccattgcttgagtaggtggttttatggccacagtataaacaaagctgccaggaagttcaaacttggtggaacccactgcaactcagcaagttggctgtgcccagacttccagatttctctgctctggacagggcatctctgtaaaaaggcagtagccccagtcaggggcttatagccaacttaaatgtccctgtctgaaggctctgaagacagcagccaacctcccagcatggtgttcaagctgtgctagggtcagtctgcttcctcaagtgggtatactgactgaaagacacctcccagttggggccaagagacacctcatacaggagagctctgcagcgcatctggcaggttccctgctgggtcaaagcttccagaggaaagaacaagcagcaatctttgctgctttgcaggctctgctgatgacacccaggcaatcagggtcaggagtggacctccagcaaactctagcatactgacagcagagcagcctgactgttagaaggaaaagaaacaagcagaaaggattagcatatccactcaaagaccccatccaaaggtcaccaacgtcaaagaccaatggtagataaatccacaaagatggggaaaaaccagcacaaaaaggctgaaaattccaaaaaccaggatgcctctcctcctccagaggatcacaactcctcaccagcaagggaacaaaactggatggataatgagtttgatgaactgacagaagtagggttcagaaggcgggtaataacaaacaactctaagctaaaggagcatattctagtccaatgccaggaagctaagaaccttgaaaaaaggtgagtctaattgttaactagaataaccagcttgagaagaacataaacgacatgatggagctgaaaaacacagcacgagaatttcgtgaagcatacacaaatatcaattgctgaattgatcaagcagaagaaagaatatcagtgattgaagatcatcttaatgaaataaagagagaagacaagattagagaaaaaaggataaaaaggaatgaccaaagccttccagaaatatgggactttgtgaaaagaccaaatctatgcttgattggtgtacctgataatgacagggagaatagaaccaagctggaaaacacccttcaaatattatccagtagaacttccccaatctagcaagatagtccaagattcctattcaggaaatacagagaacaccacaaagatactccttgagaagagcaaccccaagacacattgtcatcagattcaccaaggttgaaatgaaggaaaaaatgttaagggcagccagagagaaaggtcgggttacttataaagggaagcccatcagactaacagcagatctctctgcagaaaccctacaagccagaagagagtgggggggtaaatattcaacattcttaaaggaaagaattttcaacccagaatttcatatccagccaaattaatcttcttaagcaaaggagaaataaaatcctttacagacaagcataggctgagggattttgtgactaccagacctgccttacaagagtgcctgaaggaaggacaaataaggaaagcagcaaccagtaccagccactgcaaaaacatgccaaattctaaagaccattgacactataaagaaactgcatcaattaatgggcataataaccagctaaaatcataatgataggatcaaattcacacataacaatattaaccttaaatgtaaatgggctaaatgtcctaattaaaagacacagactggcaaattggataaagagtcaggacccatcagtgtgctatattcaggaaacccatctcacgtgcaaagacacacataggctcaaaataaagggatggaggaagatctaccaagcaaatggaaaacaaaaaaaggcaggggttgctatcctagtctctgataaaacagactttaaaccaacaaagatcaaaagagacaaagaagggcattacataatggtaaagggatctatgcagcaagaagcactgactatcctacatagatatgcatccaatacaggagcatccagattcataaagtaagttcttagagaccgacaaagagacttgcactcccacacaataatagtgggagactttaacagcccagtgtcaatattagacagatcaatgagacagaaaattaacaaggatattcaggacttaactcagctctggaccaagtggatctaatagacatctacagagctctccaccccaaatcaacagaatatacattcttctcagcaccacatcacacttattctataatggaccacagaactgcaagtaaaacactccttagcaaatgctctccatcccaaatcaacagaatatacattcttctcagcaccacatcacacttattctataatggactacagaactgcaagtaaaacactcctcagcaaatgcagaagaacagaaattagagcaaacagtctaccagaccactgtgcaatcaaattagaactcaggattaagaaactcactcaaaaccacacaaatacctggaaactgaacaacccgctcctgaatgtcttctataattttgaaagccagcttcatatttcctgccctagggggatgaagtaaagtaagcagtagatctagttagatatatgtgttattttgtttagcaagggttaatttgaattttgccattttataacaactgattgtggctgggaacatgctaatggttatggtgactgtattcactctttctttgctttgaatttttttttttttttttttttttttgggagatggagttttgctcttgctgcccaggctggagtgcaatggcacaatcttggcttactgcaaccactgcctccgggttcaagcaattcttctgcctcagcctccccagtagctgggattataggcatgtaccaccacgcctggcaaattttttgtatttttagtagagagaggtttctccatgttgaggctggtctcgaactcctgacctcaggtgatccacccaccttggcctcccaaagtgctcggattacaagtgtgagccaccacgcccagattttttttttttttttttattgtaacagggtctcattctgtcacccagactgaagtgcagttgtgccatctcagctcactgcagctttgaccttctgtgctcaagcaatcctcccacctcagcctcctgagtagctggaactacaggtatacaagtgtgtgccaccatgcttggctaatttttttatttttttgtagagatggggttttgccatgttactcagcctagtctggaaatcctgggcttgagcaatctgcccaccttagccttcccaagtgctggaaatacaagtgtgagccactgtgctcagccttgatttgaatttgagggatagtatagttctgtgttactacacctagtagaatattagcatattcagtgactttaattagaccttagtgtaatccccagtaacaatctgttgccttggatgttctgttttctttctttttttttttaaattatactttaagttttagggtacatgtgcactacgtgcaggtttgttacatacgtatacatgtgccatgctggtgtgctacacccgttaactcgtcacttaacattagctatatctcctaatgctatccctccccactccctccaccccacaacaggtcccagtgagtgatgttccccttcatgtgtccatgtgttctcattgttcaattcccacctatgagtgagaggatgttctgttttctaaaggtatatacgagattcttgtattcttttcatattagagacccctggccagagtaggagctgtagaggccacagtgagcccttcaggagaatgagatacagcagagtcactgcttgtgttcttgagatgattggatgacaaagagggaaatgataatgttaactgaggaaagtctagaactgcaggttaccatatgtatcccatattttaaccctcacctgttgttccattgtatttttctatgtaagtttttacttgcagtcctatttctttcttatttaaaaatcatgttaatcattggtattagtagcatctttgccagataaaaaggaaaaactaaagtgaatgctttatgacgatatgtgggaggaaagaatgtaatagcacttgaggaatattggaactgattatatattacatggcagtgggtagtgtttaataaaatgattatatttcatagaaagcattacatcttctttgagtgagaaacatagagataatttcatgctaccctcaccctttcttttaaacatatatatattttttttaaatttaagttagaatttgagtaattgtattaccatatatatattttttaaatttaagttagaatttgagtaattgtattacatgtggtgctgtttttctcagaggaaaaatcagcaaattatttcaaagatatggaggatatggtgtttctctatatccaggtgggactgaacaatgtattagccaaggaaaaccttccctttcacccactggaggctcactgaaaatcatgtcacaaaaagcagattaatagtagaaaagcgatacatatttattaagtcatagatctgtgtaacacaagagccttcagaacgaagacgcaaagataagatggagaccatttttttttcttaatttcaacttttattttaaattcagaggatacagccttgctacatgagaatatttcatggtgctgatgtataaggtactgttgatcccaatcaatagtggtaagcatagtggccactagctagcttttcaacccataccctgctttctccccagtctagtagtccctgtgcctattgttcccatctttctttccagatttactcaagctcccacttgtaactgagaacatacagtatttaatttcctgtatcctgtgttaattcatttagtatggtggcctccagcagtattcatgtttctgcaaaggacctgattttgttcgttttcatggttgcatagtattccacagtgcatgtataccacattttctttattccaccactgataagcatccaggttgactcatgcctgtttttgctattgtgaatattactgcagtgaacatacaactgcatgtgtcttttttgtagaaaaatttattttcctctaggtatacacccagtaatgggattgctgggccaaatggtagttttgttctaagtcctttgagaaatctccaaactactctccatagtagcgtaaatattttacgttctcaccaggagtatataagcattcctttttctctgcaacctcactagcttttgttgggttttttttgtttttgtttttgactttttaatagtagccattctgactggtgtgagatggtatctcattgtggttttgatttacatttccctaatgaacagtaatgtggagcatttttcatatgtttattgatacttatatgttgagaagtatatgtccatgttcttggcacaccttttaatgtggttattcggaaactcaatttttatgccaagattcaggaaactgcacagccagtagaaataagattggacaaaaaggccctgatctaaagctaatgggctgagtggggaaacccagccaggcctgtctgcctagattcttcttggcctttctgaacagcactttcttccttctggatgtgggataggaccctctctggaataggggtcttaggacctacaattcacactgttaggacagaagatttctttatggccagtgtttaagaaagtcagggggaaagttaaggtcatcttttatggctgctttgatagagaagcggtctggtttgtatgacctgcctttaggaggagaggttctagtttctttggccagcctctagggagaatggaattgagagacagcaggtcaggaaagggtcagagataaaccttctgcctctgaggctgttgaagtcttcattttgtggtatcattctctgaaccccaacaacacacattgttttaacttcatacaaaacacttagatcagttgggtccaaacatgggtttatacactgtgtggcaaaagtatggtccttccctctactccaaagggaacaaatgaaatttattatttatttatttatttatttatttttattatactttaagttttagggtacatgtgcacaacgtgcaggtttggtacatatgcatacatgtgctatgttagtgtactgcacccatttactcttcatttaacattaggtatatctcctagtgctattcctatcccctccccccaccccacaacaggccccagtgtgtgatgttccccttcctgtgtccatgtgttctcattgttcagttcccacctgtgagtgagaacatgtggtgtttggttttttgtccttgagatagtttgctgagaatctaacggtttccagcttcatccatgtctctacaaaggacatgaactcatcattttttatggctgcatagtattcaggggtgtatatgcgccacattttcttaatccagtctatcattgttggacatttgggttggttccaagtctttgctattgtgaatagtgcagcaataaacacacgtgttcatgtgtctttatagcagcatgttttataatcctctgggtttatacccagtaatgggatggctgggtcaaatgttatttctagttctagatccctgaggaatcaccacactgacttccacaatggttgaactagtttatagtaccaccaacagtgcaaaagtgttcctatttctgcacatcctctccagcatctgttgtttctgactttttaatattcgccattctaattgttgtgagatggtatctcattgtggttttgatttgcatttctctgatggccagtgatgatgagcattttttcacgtttctgttggtggcataaatatcttcttttgagaagtgtctgttcatattctttgcctactttctgatggggttgtttgttttcttcttgtaaatttgtttgagttcattgtagtatctggatattagccctttgttagatgagtagattgcaaaaattttctcccattttgtaggttgcctgttcactctgatggtaatttctttggctgtgcagaagttctttagtttaattagatcccatttgtcaattttggctattgttcccattgttttcagtgttttagacatgaagtccttgctcttgcctatgtactgaatggtatggcctaggatttcttctagggtttttatggttttaggtctaacatttaggtctttaatccatcttgaattaatttttgtataaggtataaggaagggatctaatttcagctttctacatatggctagccagttttcccagcaccatttattaaatagggaatcctttccccttttcttgtgtttgtcaggtttgtcaaagatcagatagttgtatatatgcgacattatttctgacggctctgttctgttccattggtttatatctctgttttggtaccagtaccatgctgttttggttactgtagccttgtagtatagtttgaagtcaggtagcatgatgtctgcagctttgttcttttggcttaggattgactaggcaatgcagggtcttttttggttccacatgaactttaaagtagttttttccaactctgtgaagaaagtcattgatagcttgatggggatggcattgaatctataaattaccctggacagtatggccattttcacgatattgattcttcctgcccatgagcatggaatgttcttccatttgtttatatcctcttttatttcattgagcagtggtttgtagttctccttgaagaggtcattcacatcccttgtaagttggattcctaggtattttattctctttgaagctattgtgaatgggagttcattcatgatttggctctctgtttgtctgttattggtataagaatgcttttgatttttgcacagtgattttgtatcctgagacattgctgaagttgcctatgagtttaaggagattttgggctgaggatgatggcgttttctagatatacaatcatgtcatctgcaaacaggaacaatttaacttcctcttttcctaatcgaataccctttatttccttctcctgcctgattgccctggccagaacttccaacactatgttgaataggagtggtgagagagggcatctttgtcttgtgccagttttcaaagggaatgcttccagtttttgcccattcagtatgatattggctgtgggtttgtcatagatagctcttatcattttgagatatgtcccaccaataccgaatttattgagagtttttagcatgaaagttgttgagttttgtcaaaggccttttctgcatctattgagataatcatatgatttttgtcattggttctctttatatgctgtattaggttttttgatttgtgcatgttgaatcagccttgcatcccagggatgaagcccacttgatcatggtggataaatttttgatgtgctgctagattcagtttgccagtattttattgaggatttttgcctaggtgttcatcaaggatgttggtctaaaattctctttttttgttgtgactctgccaggctttgttgtcaggatgatgctggcctcataaaatgagttagggaggatttcctctttttctattgattgcattagtttcagaagcaatggtaacaggtcctccttgtacctgtggtagaattcggctgtgaatccatctggtcctggactttttttgcttggtaagctattaataattgccgcaattgcagagcctgttattggtctattcagagattcaacttctttctggtttagtcttgggaggttgtatgtgtctaggaatttatccatttcttctagattttctaatttatttgcgtagagttgtttatggtattctctgatggtagtttgtatttctgtgggatcggtggtgatatcccctttatcatttttcattgcaactatttgattcttctctcttttcttctttattagtcttgctaacggtctgtcagttttgttgatcttttcaaaaaacgagctcctggattcattgattttttgaagggttttttgtgtctctatttccttcagttctgctctgatcttagttatttcttgccttctgccagcttttgaatgtgtttgctcttgcttttgtagttcttttaattgtgatgttagggtgtcaattttagatttttcctgctttctcttgtgggcatttagtgctataaatttccctctacacactgctttgaatgtgtcccagagattctggtaggtagtgtctttgttctcattggtttcaaagaacatctttatttctgccttcatttccttatgtacccagtagccattcaggggcaggttgttcagtttccatggagttgagcagctttgagtgagtttcttaatcctgagttatattttgattgcactgtggtctgagagacagtttgttatgatttctattctttcacattttttgaggagtgctttacttccaactatgtggtcaattttggaataggtgtggtgtggtgctgaaaataatgtatattctgttgatttgggttggagagttctgtagatatctattaggtccacttggtacagaggtgtgttcagttcctggatatcctgtttagtttctgtgtggctgatctgtgtaatgttgacagtggggtgttaaactctctcattattattgtgtgggagtgtaagtctctgtaggtctctaaggacttgctttatgaatctgggtgcccctgtattgggtgcatatgtatttaggatagttagctcttcttgttgaattgacccctttaccattatgtaatggccttcttcgtctcttttgattgtgttggtttaaagtctgttttatcagagactaggattgcaacccctggctttttttgttttccatttgcttggtagatcttcctccttccctttgttttgagcctatctgtgtctgtgcacatgagctgggtttcctgaatacagcacactgataggtcttgactgtttatctaatttgccagtctgtgtcttttaattggagcatttggcccatttacatttaagattagccttgttatgtatgaatttgatcctgtcattatgttagctggttattttgctcattagttgatgcagtttcttcgtatccttgacggtctttacaatttggcatgtttttgcagtggctggtaccagttgttcctttccatgtttagtgcttccttcaaaagctcttgtagggcaggcctggtggtgacaaaatctctcagcatttgcttgtctataaaggttttatttccccttcacttgtgaagcttagtttggctggatatgaaattctgagttgaaaattcttttctttaaggatgttgaatattggcccccactctcttctggcttgtagggtttctgtcaagagatcagctgttagtctgatgggcttccctttgtgggtaacccaacctttctctctggctgcccttaacatttttctttcatttcaaccttggtgaatctgaaaattatgtgtcttggagttgctcttcttggggagtatctttgtggcgttctctgtatttcctgaatttgaatattggcctgccttgctagattggggaacttctcctggataatatcctgcagagtgttttcccacttggttccattctccccgtcactttcaagtacatcaatcagatgtagatttggtcttttcacatagttccatatttcttggaggcttttctcttttctttttattcttttttctctaaacttctcttctgacttcattgcattcatttgatcttccatcactgataccccttcttccagttgatcacatcggctactgaggcttatgcatttgtcatgtagttcttgtactgtggttttcagctccatcagctcctttaaggacttctctgcattggttattcttgtatccattcgtctatttttttttcaaggtttttaacttctttgccatgggttcaaactttctcctttagctcagagtagtttgattgtctgtagccttcttctctcaatttgtcaaagtcattctccatccagctttgttccattgctggtgatgtgctgcattccttcagaggaggagaggcactctgatttttagagtttcctgtttttctgttcggtttttttccccatctttgtggttttatctaccttcggtctttgatgatggtgacatacagatggggttttggtgtggatgtcctttctgtttgttagttttccttctaacaatcaggaccctcagtagcaggcctgttggaatttgctggaggtccactccagaccctgtttgcctgagtatcagcagtggaggctgcacaacagtggatattggtgaacagcaaatgttgctgcctgattgttcccctggaagttttgtctcagaagagtacccagctatgtgaggtgtcagtctgcccctactaggggttgcctcccagataggctactcgggggtcagggacctacttaagaaggcagtctatccattctcagatctccagctgggtgctgggagaaccactactctcttccaagctgtcagacagggatatttaagtctgcagagttttgtgctgccttttgtttggctatgcccttcccccaggggtggagtctgcagagacaggcaggccttcttgaagtgtggtgggccccacccagttcgagctttttggctgctttgtttacctactcaagcctgagaaagcgtgggtacccctcccccagcctcactgccaccttgtagtttgatctcagactgctgtgctagcaatgagtgaggactttgtgggtgtaggaccctccgagccaggcgcaggatataatcttctggtgtgctgtttgctaagaccattggaaatgcacagtattagggtgggagtgacctgattttccaggtgcggtctgtcatccctttctttgactaggaaagggagttccctgaccccttgcacttcccaggtgaggcgatgcctcaccctgctttggctcatgctcggtgtgctgcacccactttctgacactccccagtgagatgaaccccgtacctcagttggaaatgcagtaatcacccatgttctgcatcgcttatgctggaagctgtggactggagctgttcctattcggccatcttggctccaccccccatgaagtttattttggagaaagttaactcagaacagaaggacctagggatatcagagagttgagatggggcaagggcctgggctccctgtctgtcctgacaaagttagaacagaaggacccagagacatcagagagtggagtgagggtgagggcctaggctccttgtttgtaagggaattgtctacactgtgcatactaatgatcatcagctttcttgtccttccttcaaagttgaaagtcaccgtactccttcaagtccatcctggaggatccctttcttcataaactgaactggccaagaaaagtattccataattggtatttaaaggccatttgggcctattacttatgtactgtacaatatgttcacctgctgaggagggaaccctggctatccacacagacctgattcttaagtgagaaaagacagtcttaaatcctagatattcttgagaaggcttcaataagaaactcattttaaaaattgaaaaaataatcatctggaggtagcacacacaccaaccaaggaaacagggacaaaattaatctgtaacctgtaggaaatacactgaagtagtgactcataaaaaaatgggaattctattaaaatgtaacatattacacaaattaaagtatcctattggagagagaatgtgaggagatctccaatggataaaacttcagttagagagagtgatagcaaagggaaaggaacaaatatggagactctaggaatctgacattcaaagagtattttcaggaaggatgacagagaatacaaataagcaaaagtgacttacattcaaatagtgtttaaaaagtaatcccagcgttattgtgtaacagtgctgaaataaatgtatctgtacatgtgtcttcatagttgaatgatttataatcctttttgtatatacccagtaatgggattgctggatcaaatggtatgtctcattctaggtccttgaggaatcaccacgttgtgttccacaacagttgaactaatttatactcccaccagcagtgtaaaagcattcccatttctccacatcctctctagcatctgttgtttcctgacattttaatgatcgccattctaactggcatgagattgtatctcattgtggttttgatttgcatttatctaatacaccatgaaatatatgcagccatgaaaaaggatgagttcgtgtcctttgcagggacatagatgaagctggaaaccatcattctcagcaaactaatacaagaacagaaaaccaaacaccacatgttcttactcatgagtaggagttgaacaatgagaacacatggacacagggaggggaacatcacacaccagggcctgtcatgtggtggggagtagggggagagatagtattaggagaaatacctagtgttgatgacgcgttgatgggtgcagcaagccaccataccatatgtatacatatgtaacaatcctgcacattctgcccatgtaccccagaacttaaaatgataataataataattgccatcatcatcatcatcatcatcatcccagcattgagggatctacacttccaggcttaggaaacaacatcagggttcatcacagtgaaagaattgaaactccaaactccaaaagcacattgtgagatttcagaagagcaaatatgtgggaaagaccataagagcttgaaggctgtattagtccattcttgtactgacacaaatacccgagattggataatttataaagaaaagaggtttaattggctcatggttttttaaactgcacaggaagcatgatagcgtctgtggtggcctcaggaatgtttcaatcatggcagaaagtgaaagcaaagcaggttcatcttatgtggctagagcaagaagaggagagagacagaacatgctacaaaattttatacaaccagatctcctgagaattcacttactatacagtaccaagggggatatacagtatcattctagagaactctgccctccatgatgccatcacctcccgccaggcaccatctccaacactggggattagaattcaatatgagatttgggtgaggatacagatgcaaaccgtctcaagaatttgtaatttcatagaatgcttcatgttttcaccaaatgttaaaaatatagaaactttcattattctaagaaaaaataattttaccacatagaactcttatcttggagcagctctttgtgggcaggcagagtcaaagcatttacgctgatgtatcatttcaaaaaatttacctttcatgcttcccttcttggaaagatgtgtgatcgtgtgttccttcaaacagtggaataaatgatgaatacaaagatggagaatctaagaaacagtggccttcacagaagacagctgaagtaattaagacatcagattattgcctggagcaggctgggacatctgacatcctagagttaaactttgaggagaatgaacataaaagaaaaggaagtaagccatttgaccaggtagaaatagtactcgagatgggctttagtccagaaaaattgaacaatatacacacagacaagcatgaaatgaaaacctgaagcagttattgtctccagataaaacaggaggtgattcaatgaaggagatttaattggggtagaaggcttagttcaggagtgattagttcaggagtaattgcacagttacagtaaagttgaagagagaaggctgggtacagtggatcatacctgtagtcccagcactttgggcggccaagacaggcagatctctttagcccaagacttggagaccagcccgggcaatatggcaaaaccccatctctacagaaaaaaaaatgaaaaaattagccagtatggtggcacttgcctgtagtcctagttatggcagagtctgaggtgggaggatgttttgaacctgggaagtcggggttgcagtgagttgtgattgtaccattgcactgcagcctgggcaacagagcaagaccctgtctctaaaaacaacaacaaacaaacaaacaaacacggggcaaatagagtgggggttgcccataggtaattaataggtaatatctaaaaacaatatatcaagaaaaaatagcatgaactatttcttagtaatatcaagaagatatttgaaggagagaagctaagaaatctgaaagcatttgccttctagcaagtgtggtcctgggatgtcgtatgctgtgcaagaaagtgctgttgtgcaaataacacctgtagtagttcgacttttaaaaattcatgcatgcgggaccatcctggctaacacggtgaaacccatctctactaaaaatacaaaaaattagctgggcatggtggcaggagtctgtagtccctgctactcaggaggctgaggcaggagaatggcgtgaacctgggaggtggagcttacagtaagcagagatcgcgccactgccctccagcctgggtgacagagggagactccatcacaaaaaaaaacaaaaaacaaaaaacaaaaaaacaaagaaaaaaaaccaaaaaaaaaaaaaaaaaaaaaaaaaaaacacctcacgcatgcctttctttgtttccaaagaaacaagtagttttatactacttacatattatggtagaatgatttataatcttttggctatatactcagtaatgggattacttggtcaaatggtatttctactattctttgtttccaaagaaaggcatggtatggaaatggtttccaacagttggagaaacaaattttttttccaaaagaaaaatgataaggccaagattgaatggtatgtgaatgtgaatatgatagttaaaagcattatttctcaaatgtaccttcccattggaatcagctggagaatgtaataagtattaatgcctgtgctatggtcctccagagatactgacttgcttggtctgcaatgcagaccgggcagtgagatttttttcagttcttcttagggattgtgagatacagcagagtttaggaagcatggatctaggtttgctcagattcttactttcatttaaaaatctgtatctgggcacaatgggtcatacctgcaatcccagaacattgtactgggtggaggtggcaggatcatttgtatccaagagctccagacaagcctgggcaacatagtgaaaccccatctgtatggaaaaaaaaaaaaaaaaaaaaaaaaaaagaaaaagaaaaaaattagccaagtgtaatagttcatgcctatgttctcagctattcaggaggctaaggtaggaggatcacttgagccttggaggtcatggctgcagtcagctgagatcacaccaccacactctagcctgtacaacagagtgagaccctgtctcaaacaaacaaacaaaaattacgcagtgtactcttcaacaagataaagtggtttcagtaataaactactaataatatgatgatttagattgagcaaacttcacttagtcatttcttttttattatctgatatgttctttataaaaagttttaattgcttaaaaatgacctaatgcttctcccaagcttccttttttttttctctctctcttaactgaagtcacagaatgttctcctttgtggagtgctaaacaacattaagaaattattagctttaaggacattctaagagtaaggttataaacctaaaacccctaaaaggtaaaagaaaattgaagaggcagtacaaagactgtcctctctcaaagggtcccttctcatggaaataggctgctattccaggtcagtgggaggtgatcctatgggaagcccattgtgtatggcccatggcaccattccagcttaattgttccaattcctcctgtttctctgactgcacatgaggttaaattaaatataattttctcagtttgcatttcccaggcagtcatcctaagtggcttcttgaaggcggtctgtgcattccgctatctaattctgtgatgtcctttaactcgagggccagtgacatgattatcagctctagaagttcattctgtggtcagagatgcttgtgcagtggccattttctttcattatgatctggcctttcccaagcttcagaagtgaagagaattgactttcctactaatgagcattggcacttaggaagtgaatactttatcttttgcagctagtgtgttctacatttcttcagtgtacctcctgcctggtaaatatcagattatttgttgaccatctctcagggtatagttctttgtgttattaaatgagaacctagtggcttacaaagcattggcttttgaggagccacttttatcctagatgataactcaaatccatacagtgctgatatttacagctgggagatgacattgtcttatctttgggtctattgctcaaatttctgatttcagcaggacttactcactggctgccttctgtcttggggatgcctttgatctgtcttgccttgggggaccctccctctgacctggattagcagcctatttccacaagaatggaccctctgagagaggacagtcttcgtactggctcttccgattttcctttatctgttatgggttttgggtttataaatttactcttagaatgtccttaaagctaataattttttaacgttctttagcatattactaaaagctattcatctgcttgagagactgaggaaggagtgttgcttgagcctgaaagattgaggctgcagtgagctgtgatcctgccactgcactccagtctgggtgacagagaaagaccttgtctcaaaaaaataaaaaggacaggtacaatagctcatgcatgtaatcccagtactttgaggggctgaggcaggaggattgctttaggccagagttctagaccagcctgcaacatagggagatccatctcttcaaaacataaaaaattaattagacatgatggcacatgcctgtagtcccagcttcttgaggggttgagaccagcaggaggatttctagggcctaggagttccaggatgcaatgagcaatacttatgtggttaatacatattgaaaccagttgttggagaattagtatgtgttctcccacaaattcagtatgtttttgtaatggtccaactaattcaaatggtataaacataatataagcaaattattttatgttgtttgtttaaaaacctttttgactgaatcagtctatgacgctttagtatttgaagttgtgggcagaacttagtcttaagatagcactcaccttggtgatagatttccatggagggaatttttgccagatgttaatttagcctgaagatgttatagatgtggacagtcacgccctctaagtctggggtgggctaattgaaaagaacatgcaggaaccaggcttgttaagggataaacataggggaaatggaacaattatggcagagattgaattgggtttaattgggttaggaagagtgaaagaatagattttaataagaggtctggaaatagccaagaaacccacttattgtagaaaatgtgtgacatctgattaccgtagtgaaagaaagatcccccttcaaaaatcctatctatacagaaagaagtggtaggtaaaaggaaatcttcccatggatgtatttaagaaaaacagtggggaggtctgagatttcaaagggccatggttcagattataattcaaaagagaggcaagtgatagttcccctcttcttgggtttcaggaagggggaagatttggccacttgtgaaataattttggagcttctataaccttgagcctttcttcttattttttcctggacttgagacataaggggattgataagatgggaccagagaaaaagcaggttttgaaatgccttttttgattctgttcatttctggaattcttcatcatggtccttaaagagtacatatttgttcctgatacacaacatgcagtggtctattaatgaagctttatttcctcagctaggttgcctcctccattaatttgtgggattttagatgaaaacttacttgaactgtggttttctctgtgtttgtgaatggaaggacatgtttgtctttgaccttcctttagtttcacatcttagtcttaatatttaagtagctttgtttcagacagagaaggaccatgcgttcagttgctgggactgctctctaggttagaggctttctggtcttggggaagattccccacaaactaagcaagtggcatagatgcttaatattctaagtgagagaagcactagagttttttattcattacttgtgagcgcagatgtggcctctggggaagctcagctgaggtggtctcatgttccaccaaaggtcaccagagagagatggccaggaagacaggaagacttgtctcacctgggagggtatggcaacagctatgcaagacctcttgttggagatatgtgacattcattcatttatttattttttgaaacatagtttcattctttcacccaggctgaagtacagtggcacgatcagggctcactgcaacttccctgtctcgagctcaagccattctcccacctcagcctcctgagtagctaggacagcaggcaggtaccactctgtccaggtaatttttaaaatctttttagaaacaaggtattgccatgttgcccaggctggtctggaactcctaggctccactcccgcattggcctccaaaagtgctggtattgcagggatgagccttggtgcctggcccatttattcttaagtacttatgctcagggcaggtcttccaagggaagaaaagaacagccagataagactcgtatgagatagctgaggaggcggcatttcatccttctatgcatatcctccttatccacaagcagaatgctgtcctacaaccattgctgtccccattaggtcatgataggtagacatgcaggtgatgaccacagactggcagttagccaaggattctcagtgttgcacgttgcatgggtgagtgtgtgtgacggatgcctctggcagtttggtggaaaattggtacgttttgtaaaaatgatatgtttaagtcttctaataaggtaaatactcataagaggaagtcagttttattgaaatagttagcacatatattaatattaatatttaaggccaggtgcattgactcattcttgtaaatcccagcatttggggatgctgaggtgagaagatctcttgaggccaggagttcaagttgccagcctggacaacaaagggagactatttctacaaacaataaaataaaaaaaaataaaagatatatttaaactgggctgtagtaatacatgtgtatctttattgtatattaagtagctggatctacttatgaggttcatactagtcacaatttcttagtacaattgagtttaaacaatattttggggtatttgtcctaccaacattgataatggaagaaaatactaaatttcagtgcacggtaatgaaactaaacatgtaattcctttttcccattgcagttagtagaacccatagaatgtatctaaagacacctaggtggcaaaaggtaaatgcttgagggtatgataccccattctccatgatgtgattgcatacctgtatcaaaatatctcatgtacctcataaatatatatacatgctgtgtacccacaaaaataaataaagaggaaacttggatgggattgggatttttgatgttagggtggagaacgtctgcattgaggattgtgtagagggaagagttttgatttattatacccgtttctttaaaaaaacaaaacaaaaccaaaaaaaacctgcatgtgatgtgaggaattttgccagaggtggggaacgtgaaactcactagttgaaaacattctatactgaggtaatttttttatgtcaaaaagaaagtgaagagtgtggcagattaaaatcttcatgttatttgcattttacaagcttggaagtctcaatatcaattattattgactgctatttactgcaatttttgacacaaaacatacttcattttaatgaactttgccttgtttgaatgttcgtaagactttggagggagttttagaaagagatagttgcctttgatccctgaagtatattatttggtctatcctgattctgtctcttgactttgcacttgtctttcctgaactctgtttaaaagaagcttttttttatgcctcttttcttccttcctattctaatatgagatacagaggtttttatgggtaacatcttgtctatatgccagattgtggaagccttggttgttacccagggatggaaggtctgatctcagttaagttctgaccctaggataagaagcccctctggagtaactgactcagtggggtagagcctattttcacaaattaatattcctgtctggggatggcagtgaaaacattttgggcagtgggtggaaatgataatgttcaagcctgaagatgaagtttgccttttctcggagcttgtacagtgtcatactccggaaataaactgtgtgggaaaggtggtgtttagtaacctagagctgtacaccttgcaaggccctcatcttgtcattctgcactgtaagaagcacatgaagaaagagtgtaggctgtcagagagagcgtcacactgaagtaggcacttcttacatacagctgtctgcctaaaatagagtaactttagcaaataggatctgtgatatagaaattggaaactctagccagggttgtgaaaaatggagctggggtcacaggtggtggactggaaaacgttctgaagaaactcagctttttggatattgtacagttcattaggggagctatgagaagcagttatgaagctccttatgaacgaaacgtagaggccgggtgcattggctcacacctgtaatcccagcgctttcggaggctgaggcgggcagatcatgaggtcaggtgattgagaccatcctggccaacatggtgaagccccggctctactaaaaacacaaaaattagctgggagtggtgttgcatgcctgtaatcacagctacacagaaggctgaggcaggagaatcgcttgaaccagggagttagtagttgcagtgaaccgagatcacaccactgcattccagcctagcaacagaggaaatctctgtcttaaaaaaagaaacaaagaaacaaaaacaaagaaagagacatagaaacatacccatcagtgttactcaggagggttctggttcctgttttgcacttggcagtacacacttgttcttgtccacattatcctccatctgtccacatgatcaaccatctgcagtcccaccaccagccaagggtcgtgccaggtcagaagtactactccaggtcaaactgtgttattttgaaatggagttatttgttattgttgttcttactcaaactagcagttttcctttgtagaagaactcggtttccactctgggttaaatatttcgtttatgtgatcaagattatctctgtccatcagatacagcagtgagaaacccttttataggaaatggggttaaaagtgacaggatatctataattgtttattttgtttgctaaattgcaggtaaatatattcgcagaactagttttgataacctttttaaaaataggcttatttgacgttggctgaaactaagactctagaactttactgctacatcaatgaatgacaagtctctctattcagcatgaaatccctgcagacaaaaaccacagggactacatcatgaaggctatgagaattttatggtggaaacctgagtgaagcaggtggtagaagaatctaatgtagtaccatgcccacaggagatgatctaagaatgccctcacacctaaccttgcaagttttctaccttctgtgtcttggtttcctctaatttctttgtctcttttctcccttttaatttaatagggtttgctgaagactttctctcttccaaggtcaagtgttagtcatctctgggctttgccgttagatactcatcatagtctaacaatgaatgtaagcactgaggaagtaagtaatggtgacaatgtggatgttccttttggtatcatttttctcatgctctgtaaatcttggtggtctcatattcatattattgaataccaatgcttaacccctctctgccgtctttacagaagtcccctggtctacctctctctacgtgtctaaaattgtagaattgtcttctagacactctattgcaaattcccttctgcacaagcccaacatttcacagaaggagcaggtggggggcaatgaaagagagcatggctcaattgtagcaattgaaaggcaagctttgtctcatcagctgcagtgtttactacttgaggatgggaatttgattggtgtatctttacattttatcaaagtgggtttcaccatggaagcattcagtggtacctcagtgaataattataattagctaggatttctttggaggatatttattgttctaaatttgtatatatttatatgtacatactgtattagttcattttcatgctgctgataaagacataactgagactgggtaatttataaagtaaaagaggtttaataaactcatagttctttgtggttgggaggcctcacagtcctggcaaaaggcaagggaagaacaaaggcacatcttacatggcaacaggcaaaaagagagagcttgtgcaggggaactcctctttaaaaaaccatcagatcttgtgacctcatagttcacatgagaacatgacaatgaataagtcatgggtggaaactgcccccatgtttcaattatctcccactgggtccctccccttacatgtgggaattatgagagctacaattctagatgagatttgtgtggagacacagccaaaccatgtcacatacatatgcatatctttatgtaggggatctttatgtaaggtatgtgaatacaggtgtgtatattcatatactcttgtactttctcaaacacataccatagaatgtgtaataatgtgtctggaattggtgggttcttggtctcactgacttcaagaatgaagctgcggaccctcgcggtgagtgttatagctcttaaggtggcgcgtctggagtctgtcccttctgatgttcagatgtgttcagagtttcttccttctggtgggttcgtggtctcgctggctcaggagtgaagctgcagaccttcgcggtgagtgttacagctcttaagatagtgcatctggagttgttcattactcctggtgggctcgtggtcttgctgggctcaggagtgaagctgcagatcttcacagtgagtgttacagctcataaaagcagcgtggacccaaagagtgagcagtagcaagatttattgcaaagagcaaaagagcaaagcttccacagtgtggaaggggacccgagtgggttgccaatgctggctcaggcagcctgcttttattctcttatctggccccacccacatcctgctaattgtagagccgagtggcctgttttgtcagggcgctgattggtgcatttacagtgcctgagctagatacaaaggttctccatgtccccatcagattagttagatacagagtttcgacacacaggttctccaaggccccaccagagcagctagatacagagtgtcgattggttcattcacaaaccttgagctaaacacagggtgctgattggtgtatttacaatcctcgagctagatacagagtgccgattggtgtatttacaatccctgagctagacataaaggttctccacgtcctcaccagagcagctagatacagagtgtcgactggtgcactcacaaaccttgagctaaacacagggtgctgattggtgtatttacaatccctgagctagatataaagactctccacgtcctcacaagagcagctagatacagtgtcgattggtgcactcacaaaccttgagctaaacacagggtgctgactgatgtatttacaatccctgagctacatataaagattctccacgtccccaccagactcaggaacccagctggcttcacctagtggatcccacaccgaggctgcaggtggagctccctgccagtcctgcaccatgcgctcacattcctcagcccttgggtggtcgatgggactaggcgctgtggagcatggggtggtgctccttggggaggctcgggccgcacaggagcccatggagtgggtgggaggctcagacatggtgggctgcaggtcctgagccctgccgcatgggaaggcagctgaggcccagctagaaattgagtgcagcgccagtgggccagcactgctgggggactcagtacaccctctgctgccactggcccgagtgctaagtcccccattgcccggggccagcagcgctggccggctgctccgagtgcggggcccgccaagcccacgcccacccggaactccagctggcccacaagtgctgcacgcagccccagttcctgctcactcctctccctccacacctccctgcaagctgaaggagtgggctccagccttggccagcccagaaaagggctcccacagtgcagtggaggggctgaagggcccctcaaatgccaccaaagtgggagcccaggcaggggaggtgacgagagccagcgagggctctgaggactgccagcatgctgtcacctctcaatcccccctctaaacaggacaccccaactgctgttgggaatttggccaatgaccgctttggctacttcctgctgcataggggtgaagaaggggccctgaagttgtggtatccttcagaggggaactctctaggccaggggaagtgccagcaagtcggtccaggggtcctcggtagaagttgttagttgaactcatttggggttccatttgtaagaccatctgtagcttgatggcctcaattctagaggaaacaaacttgacaagaaggttaaaaatacagggcccaaaggcgagtaacagcaagatggctgccacaggacctagaaaggggagaagccatgttgcccaactccagaggttggtataagaatttgaaaggcgttgtctgatttcagaagccttttccagtaaacgccgggcagcatctcgtactatccctgattagttagtgtaaaaacaacactcttcccctaagaaggtgcagagtcctcctttctcagcagtgaggcagtctagacctcggcggttttggagagtcactgctgccaaagagtctatttgggattgtaaagtaagaagattttgttatttcttgcaaactatctgacaaatcgtttgagagtgtgtggtagtaggataatgaagttgatagaccagctattctggttcctgtagcagtagccattcctaacactataagtaggggtattagttgtacggctctgcgctgacggacttgagctttgaggggtactgataaggtctgatttcctgggacaatgttaatgttaggacttagaaagactaaggtgcatgtgcctgtccagttagtggggaggcagatataggttgacattccacataagaagaatatgccttggctgggtagacagaactggttatgtatgttaaaaaaggtgtgtgagtttgttgttttcattttcccatactcctagagtacttgccaaggtacctccagtgagcagctggaaaggggtgttgggagaaaactgagtggctccctgtgttctattttcccatcggagaaaaaaatgttttgtatccactaggaaccatctgatagagtgattgaaagaggggatgagaaggcattcactagtggtaggggcgctgttgcagggagtccaggggtgattggtcatgcagggagtatgtttgccattgcaaaacctggactgtttgttcaccagggaggaggtgatgattttggggggcactgagaagcagagaaggcatcagaatggagctgtttgggtgactcaaaagttactatgatcatttggagcttgaagttgtaaggtgtaattacactgatgcgttggtaggtgccgcagaggcaggcctgataacaggttgcattggatgcataaaggggcttggaaagttaagatagtgttcgtggttacaaggcttttcattgcttgtgtaataggtgaggttggaaatgtaagaacataaaatttgggttgcacgtcctgttagggtacttttggtcccatcagatattgggaagtcagccaatgattgcatatttagaagttggaaagggtcttttccttcgtaacgagggtggaaggtcaagttggtaaagacccagttttttgcaggaatgggagtggcaacgtaggcagaggttgatagagagatacacagccaacagtcatttgccagggaagtattggactggtttaacagagtgtgagttaagttgagagtcttgtagaggtaattaggagctagtgaaaggggaggggtgattgtatgaggtttccaaggaagcaggagggatacacaggcaaagagcaaataggaaggtaaagagggtgctccagaaaatgagatcattttatctagtctgagttagaggtaggagtaaattactgtcaaaaggaaggaagatagaaaggaggttgatgtgattaggattttcattctggcaggagctagagtatattgtcctatcacaaagagtatggttagtgtgctgttttcacttatcttttttaaggaggaagaggtctttcctcaggatcagtggtaggagcctttttagtctgggatgtttccttctgaaataagaggtgcaagtcctccaacggttcgcaggtgtatcgaagctggtctggctgatcttgggactcctgagctgatgatccagcaggttcctcaggagatgtccaaagtttaactcgggtgtggtgaatccaagtttccactcctgccatgttaactgcaatgggagtagagaggattatagagtatggtccttcccacaaagagtccatagatggggaggtagagggaagagatttgaccaacactagatctcctggttgaaacaactctgttccctgttctctgtgacatccttcaggtagatttttaaggttttgttgatattttgccaaagttatatctttgacaaagttggccatttcctgattgagtaggaggtcatttgtgagaaaaggtcgcccatacagcatttcatatggactgagccctattttgtggggagaatttcgaattctcaacaaggccatgggcaaaagagtaggccatgggaggtgagtttcttgtgttagtttccttaagtgcctcttgagtgtttgatttgccttctcaaccttcccagaggattgtggcctccaggagcaatgaaggcgatattgtatccctagtgccttggagattccctgagttatcgtggctttaaaagctggaacattctcactctgtaagctttggggaagcctgaatctaggaattattaggactttaatcacttcctgagccttctctgtcttgtaagagaaagcttctatccaatttgtaaaggtatcaacacagaccaacaagtattgaaatccctttgacttaggcatatgggagaagtctaactgccagtcctctccgggatagtgacctattctttgttcccccacaggggccttatgatataccaagggataattcttttggcacacctcacaggctttgactacctgtcagatggtctggaggagatttggccctgtaaatagggatttggccatttgattagtgttttcaatacccatatgaaaagtttggtggagggtcttaagtattttccactggctgccttccggtataagtacctttccttcttctgtcaccaaccaccctgaagggagaaaactatgcccccatgaaagtccccattctgtttcagtccgggaatactggggcttcatctcctggagggggttgttccataccaagggtccttccataggcatttctaatgggacattcctcctggcagcagctttgacctcagcatctgcctgatggtttccttctgccttttctccttcacctttctgatggctttgtcagtgtaagattcccacctctttgtgttttttcactgtgtgactgggcgggcatttttttgccctttcagattgtccttccaatgcccagacttcagggttgattccctcctcaagtaggggacaacaaatgggtaaattgttccccatattcatgtagataatagctccagccttggctaatatatccctccctaataagggtgtgggactttcaggcataacaagaaaggcatgtgaaaagagcagagtctcccaattacaactgaggagatgggagaaatacctgattacaggctgccccaggattcctcagatggtaactgaccttgaggacagtcgtccaggacaggagattaacactgagaaggctgtgccagtatccaggaggaagtcaatttcctggtcatcaatagttaaacatacctggggctcagtgagggtgatgacatgagctggtgctagcccctggcaccctcattccttctgttggatcatctggttgggggcttctgacccagggaaacttcatcctctggggcagtgcaccttccagtgattgcctcggcatagtggacacggacgagggggcagcttgtttcttattggacaatcttttttaaaatgtcgtagtaaaccgcactgataacaagccctaccaggtgattggcctgctccattttctgacctctctgaaccaccaaagtttgtttgtctgagggccatgactaaggctgtggcctttctctgatctcgcttttccttttgggcctgttcttcttggtccctattatagaacactgaggttgccaggtttaataatgtctctagattttgttcagggcccagggcttgcttttggagctttctcctgatatctgcagctgatggattgggtaataaacatatcttttagaatcaattgaccctcaagtgattcaggtgacaggggagtatattttcttaaggcctctcgtagccgctcgaggaaggcagaaggtttttcttcctttccctgggttatggtagatatcattgaataattcatgggcttttttctaattctccttagtccttccagaacacaggtcaatagatgtttacaactccagtccccatgatctgagtcaaggtcccagtggggatccgtactggggatggcttgctgaccagtagggaatttgtccctttcttcagctgtcattctatcatttacttgactaagacaccaggtatctccaaactcctaggctgcagctaaagccgcattcttttcattaaaggccagggtttgaactatcagtagcatgacatctctccaagtgaggtcaaaggtttgccctagatgctgtaggacatctatgtacctatcaggatcatctgaaaacttccccaggtctgccttgatctgctttaaatcagagagggagaaggggacatatacccgggttgggccaaattcccctcctgctacagattgaaggggacataaccgacagcccgggggtttttgtggtcctttggagatttctttgcttgtttccttccgggcaggggagattagaggaggagtatcaataataggaaggggagctatagggaggctaggatataggggtaagctgaggggtcctcctctgggatgtaaattgcaagctttgcatagttgtgtattctccctcaatgaaaagaaagctcggacataaggcatttcactccatttgccttccctcttacagaaaagatcaagctgcaggatagtattgtaatttgtacttccctcaggtggccatttttccccatcagaaagagaatattggggccaggccgcagtgcagaaaaaaaatgagctgcctctttttcagggtttgtgggtcaaattggtcccaatggcttaggatgcatttcaagggtgagcctgttgatgcctgagtgtttcccatctgaaagacaaaattacccgcagttttggtttgttttgtttctctccctgtccaagaacccgcaacggtccctggaccctgctgatcggaatagttgcactcactgacgcagcaacagaaacactagttttcctcccagaccacatggaggaccgaggaaggtcggatttagtggtccttactgacgcaatgttgaaaacctgcacccttgcttgtcctcctagaccacaaggaggaccgactgagaaaaatcggatttagtggcccttaccaacgcatcctcaaaaacctgttagagtcctaagcgttctcctgttagtattaggactttacccctgtcctataaagatgttatgccccaaaaatgaaatggagggccataccctgagggagggaagggatcttcatggttggaagagtgacaccttttgtcctcacttataggaaggatacaatttctgaggctccccatatcctagcttcaggaataacttttgttaggcctgttagtctgaggagggatcctaaaattccaggtagtccccactatgatggggccttgggcaaaaactgtatctttctgattggtgagcccgggtgcctaaagaagataacagagtcctggagtttatactagaagtcattcttataggagaaacaagaaaagcaccagaggcaggtagcaatttttagaagcgggtctagactcagaagagaggcgagaggaagtttgtctggcaggcattgggacccagagggcaagggtcagtatagataggatagataggcgagtctcgcttgggcgacatgcttgagagttccgctcatggctgcagggtcaaccaacatgttgttgggaccccggagatgcatggctttcctctctgtcgaccctcggctcagcccagaagtacagaaaaagcagaagctggttctaggtaaaacaacggtcccaactccaaagagttgggggttgttagagagccctttcccagaaagcctgacacccgcgtctttagtctggcagccacactagttgcctttaactggctgacaggtgcctggtatttagcccccgaattctaaggaaagataggacaatatagcaagcgaaaggggtccaatggtactcactgcttggcgataggtgatggtctcaccgcttggcgattgtctcaccgcttggcaataggcgatggtctcactgcttggcgataggcaaaagtcccttcgtggtcaccaaaatgtgtctggaattgctgggttcttggtctcactgacttcaagaatgaagctgcggaccctcatggtgagtgttacagctcttaaggtggcacgtctggagtctgtcccttctgatgttcagatgtgttcagagtttcttccttctggtgggttcgtggtctcgctggctcaggagtgaagctgcagaccttcgcagtgaatgttacagctcttaaggtagcgcgtctggagttgttcgtttctcccggtgggctcgtggtctcgctgggctcaggagtgaagctgcagatcttcttcacggtgagtgttacagctcacaaaagcagcgtggacccaaagagtgagcagtagcaagatttattgcaaagagcgaaaaaactaaccttccacagtgtggaagaggaccggagcgagttgccaatgctggctcgggcagcctgcttttattctcttatctggccccatccacatcctgctgattggtagagccgagtggcctgttttgtcagggtgctgcttggcgcgtttacaatccctgagctagatacaaatgttctccacgtccccatcagattagttagatacagagtttcgacacacatgttctccaaggccccaccagagcagctagatacagagtgtcgattgcttcattcacaaaccttgagctaaacagagggtgctgattggtgtatttacaatccttgagctagatagagagtgccgattggtgtatttacaatccctgagctagatacagagtgccgattggtgtatttacaatccctgagctagacataaaggttctccacgtcctcaccagagcagctagatacagagtgttgattggtgaactcacaaaccttgagctaaacacagggtgctgattggtgtatttacaatccctgagctagatataaagactctccacgtcctcaccggagcagctagatacagagtttcgattggtgcactcaaatcttgagctaaacacagggtgctgactggtgtatttacaatccctgagctagatataaagactctccacgtcctcacaagagcagctagatacagtgtcgattggtgcactcacaaaccttgagctaaacacagggtgctgactgatgtatttacaatccctgatctagatatacagattctccacgtccccaccagactcaggagcccagctggcttcacctagtggatcccgcactggggctacacgtggagctgactgccagtcctgcgccatgcgctggcattcctcagcccttgggtggtcaatgggactgggtgccgtggagcagggttggtgctcgtcggggaggctcgggccacacaggagcccatggagtgggtgggaggctcagacatggcgggctgcaggtcccgagccctgccccgtgggaaggcagctgaggcctggctagaaatccagcgcagcgccggtgggccagcgctgctggggtactcagtataccctccacagccactggcccagatgctaagtcccccattgcctggggccagcagggctggccggctgctccgagtgcggggccagccaagcccacgcccacccagaactccagctggcctgcaagcacagcaggcagccccggttcccgctcacgcctctccctccacacctccctacaagctgaaggagtgggctccagccttgtccagcccagaaaagggctcccacagtgcagtgggggtactgaagggctcctcaaatgccaccaaagtgggagcccaggcaggggaggtgccaagagcaagcaacggctctaaggactgccagcaatgctgtcacctctcaataatatccctgaattacatctgctactccgctgctctacccatctaacaagtaagtgatggagacattgatggttctattagtcagggttctctggagggacagaactaataggagatgtatatatatatatatatatatatatatatcgctaacccttaccataacatatatatgtgtgtgtgtgtgtctgtgtgtgtaaaggatatacaaatatacatacaactaataggatatatgtatgtgtgtttatatagataatatctatgtttttatataaatatatataaattatgtatatgaatataacaaaatatatatttatatatagtatatataaacacacacacagatatatatcctattagtgataagtgataaagagtagtgtttatatatatacatatataataaattcttctttatatatatatacacatctatatttgtgtgtgtgtgtgtccatatatatatataagtttattaagcagtatgaactcacgggatctcaaggtcccacacagtagacgatctgcaagctgaggagcgaggaagccagttagagttccaaagctgaagaatttggagtctgatgttccagggcaggaagaatcaagcacaggacagatgtagacttggagggtaaggcagtcttgtcttttcacgtttttctgcctgctttataatttctggcagctgatgagatggtgcctacccgcttgagtgtgggtctgccttccccagcccactgactcaaatgttaatttcctttgacaacaccctcacagagacacctgggatcagtactgtgcatccatcaatccaatcaagttgacactcagcattaaccatcacaatggtgtacaactgactggagttaaagtgagagtcaggctttgaatcatagtcgtaaaactgcacaaattctctgccccatactacctcccagacacataatacatgcaggagtaggtgtttttgtgcctgttatagtgcatttgagcctgttgttctttactttgctcttgtgtcagaccatctctccaaaaacagatgatcagcatcatacacaactggtagtattgattatctgcagcataaagcatggaacatgggattttcagggaatggagtaggaaaaattcctgaacctaagcagcttaataccttaatatttcacttggttagtttgaatacatatacttctacacacacacacatgaaattacatggataatataagctttaatgtattgtatatataatataaatctctctaacctccaaaaatgtatatatccaaactatttgtcaatttctctctctctttcccccctcttgctctttccacatatttatgtataaaacagtttttcaaactaaccaactgaaatattaagctcctatgttatatatataatatatatttctgcaaataaccaaaatatcaaagcaattaagctcctgtttcatgtatctattgtatatagatatatgtgtgtgtgtgtacatgtatacagtatttctccaaactaagcaactgaaaaatattaagctcctatgtcttacatatataaaatatttattcaaataagcaagcaaaatattaggctattaagctcctatgaataatgttttattttattctatataaatagaataatatgaatatgtttcatattattctgtatattatatatatatacacagcaggttagtttgaagacatgtatgcatatattaaaatctactttataatttgatatataataagttaagtacaaactttcatgaaatatgtatgagaagaaggaagactatttttatagtacgattagtacagtgaattctggggaaaaagtaaatactcatttcaaatcctcatgtacaattcaaataaacaaaaatctggtggcatgtttacagcctgctaatatagattatgtggtgttggaaaacattttatttttacaagtacctagtaggtgtatatatttgtgggttatatgagctatttcaatataggcatacaatgataaaaatcacattaaaataaatggggtacacatcacctcaagcatttatcgtttatttgttttacaggctttcatttatacttttagttatttaaaaatatgcagtaaattagtgttgactgcagataccctattgtgctatgaaatactagatcttcttcattctgtctcactatatttttgtgcctattaaccatccccacttctctatccctcccattactctccccagcctatggtaaccatcattctattctctgtctccctgaaggcaactggaaggctatttttctttttttctttttctttttttttttgagacagagtctccctctgtcacccagaatgatgtcgcccagtgatgcagtctaggttccctgcaacctgccccttgtgggttcaagtgtttttccagtctcagcctcccaagcagctgggattacaggtgcacaccacctcgcccacctaatttttggtggtttttttttgtagacacagggtttcaccatgttggccaggctggtctcgaactccttacctcgtgatccacccacctaggcctcccaaagtgctggaattacaggcgtgagccaccacacctggcctgaaagacatatttttaaaggataggctggaaggttgcattgactttcgctgtttctggctcactaaatcctgctattttctgcagtagggattgctacacttacgttatgctttcctactgcagagaaggacattctgttcccactgggctcctatactgcctctacagtcggctttggagataacagcctgaggcgtcagagcgtcttggtggtgaaagcatcttaagatgtcactggcacggctgggtgctgtggctcacgcctgtaatgctagcattttggaaggctgaggcgggcggatcacgaagtcaagagattgagaccatcctggccaacatggtgaaaccccatctctaccaaaaatacaaaaattagctcggcagtgcctgtagtcccagctactcgggaggctgaggcaggagaattgctttaacctgggagcagaggttgcagtaagccgagatcgagcaactgcacttcagtctggcgactgagctagactcggtctcaaataagggggttaaaaaaaaaagaggtcactggtacaagcccttgttttgcagtggaaggagatgaagtccaggccactatatgatgggccagagagcacgtggcttattagtgaccacggctatagtggctcaagttccctggctgctggccatggctggcaggatcccggggcttttctgcctaatacgtgggtctgttgccttgggtgtgttgcattgggcttgtcgcataatcatggagaaatagattttctcttcaatttttaaatccaagatattttggcagcacatgggaaaataaagtcattgagtaagaaaacctatacagatgagcatcttttgattaaattttcattataaaataatcacagtcacaaaacctgaatcaaaacgtatacacagataatcatcttaaagagtaaaaaataatcaggtacatagtattgtactcactgacagaccaggaaagagcattcccactgtttttgtatatcagtgtgagtttgcttcctgtctcctacctcgcagagaaatgtacttcctcaggattcggttttcagaatgcccttgctatgttatttcaggacaaacatagttctgagcaatatattgtttagttttacccttatgtaaatgaaaatcacactatttgtagtgttttatggcttggcttttatgtttgaggttttcccattttggtccatatatctgtattttattcattttttactgttgtgtaaagctttctgctttaatatgccaacatttatttattcattgtcctatttatggatatctggattgtcgtaactttttttgcaattacaatttgggttgcattgtccccagcaaactaatgcagggacagaaaaccaaacactgcatgttctcacttataagtggcagctcaacgatgataacatgtgaacacatgtgggtggagaacaacacataatgtggcctgtctggggatttgggaggagggagaacatcaggaagaataactaatggatgctgggattaatacctaggtgatgggttgattcgtgcagcaaataaacatggcacatgtttacctgtgtaacaaacctacaaatcctgcacatttaccatgaaaattaaaataaaagttgaagaaaaaatattggggctgcaatggacatttctgtacatattttctgatgcaaatattttagaaaccctatagaggatggatgtgtgtgtgtgtgtgcgtggtgtgtgtgtgtgtgtgtgtctactttcaccataggattctgtatcttctactttctaatgtgatttaaaattgttttgcagtggggttgcacagaggctcagcatcattgcatgggagttctagttgctccagatctttcttcagtagttgatatcattgtatcaaatttttattaatactattctgatttcatctgcatttcaccaataatgaatggcattgagcctcttgtcctatgttgaggctatctgtagatgtgaggacttcttccttgatacggatttatggtggaggaatcaatcaccaaagatggctctgagtgtaggctgaatgactaaaaatataatgatctagttatctaaatataaaacaaaattgtttaagcaatttgggggattggagaatgagagttttaggagaaccataagatatctatctgactatattcttcaagacaagatagtcatggcagtacaggcatggtggcacataacattttgtcacctggcactacacgagtgtgcttccatgaccttgaggatatatatgactttgagtttggtgagacagatgaacacaaagcccagagaatctgcaaattatttgacttagatttagatattgtgtttggaaaacatttgacacagaaaatcaagcattagcaagcatttattatttgcttgtgttagctttagttatgcagatgatgaataataagaaaaaaagcatcacaggtagggatagatactgtcatgaaaatttaagcttctcatgggcaggaactcattcttaaccccactatgtgcccttactaagcgcagtgatctttatgggatacttctatgatctgaagacttgtgtccttccagaatccacatgttgacattgtaaacccaaagtgatggtgctaggaggtaggggctttggagctgccgagatgttgagagtggatgccacgtgaatggcattaatgacattttaaaagataccccagggacattacttgctcctcccctcttttccaaagtcataaggaaaagtcagccctctaggcattgggccctcaccatacactgaatctaccatatcttgatttcggatttccagtctccagaactgtgagcaatgaatctctatggtgtataagccccaccaccacccgccccaacgacactcaccccaggctatgatattttgttacagcagcctgaatggactaacccaacttctgtgctttgctgttgtcttatttctttggtcagtgtaggatcttgctgtccgcatagtttgctctagaaagatggatgctctattcctaatggtgtatttggccttcctatctatggaatattctcctatccaatcagtcttggtaacatataaatgattaactctacccttgggtatagttttggttctgctaagtcccctgctgaaaattctggtttctaccattatggctcatgcatgttcctgacccattaaacttcagtggaagaatagaaatggagagggaggtgatggagttgatatcttaaactgcaatatggtgcaagcccatcttgcagataatatatttggtgtcttccttatctttttaagagcggccttgctatgttgcctagcctaaaatcaaactcctgggcaagtgatgcttgtggctcagcctcccaattacctggcattacagacatgtaccaccatgcctggccacgtttttactctccaattacttaatatatagtaaagctaatggttcacagtggttcatttttttgtgtgtattccaataacattttatttatttattaccttgaacatattcaatatttatttgacaagtttttataattttaacatttttttttaattcatgtggtatgagtgtaagtttttttctctgggtgtattggatggtgctgaggtttgaggtgcagatgattctgtcatacacctatggagcatggtacacaataggtagttttccaactttaccctctctgtcacccctatttagtagtcctgagtttctgttattgctttatgttcatgagtatccaatgtttagttcccacttataagtgagaacatgtggtatttaactttctgtttctgcattaatttacttaggataatggcttccagctgcatccatgttcctgcagaggacatgattttgtttgtttttatggctgaatagtattccatggtatgtatgtatcacatattctttattcaaaccaccattgatgggcacttaggttgattccatgtctgctattgtgaatagtgctgtaattagcatacgtgtgcatttgtcttttttgttagaatgatttattttcatttatatatatatataaaacaattaatgggattgctaggtctgtggtagttcctcttaagttccttgagaaatctccatactgttttacacaatggctaattcacattctcaccaacagtatatgtagccttctcttctctgcagcctcaaagacacctgttgtttttgatgttttatgaacagcctttctgactggtgtgagtttttgatttgcatttctctggtacaaaatggtggattttgaaatgagatttgatttctaaattttatagaaactgcatagatgactgcaaagaactctttaagatatgacaaaagacaaattagattgtaatctcctttatacaggacaagaaataaagaggagaatattaaaatatgtacacatacaaaagtagatgaattggcgattgttggtgttggatgcatgttaagcagggtgaaggaggtgtgtgtgcatgcattcgtggccatgtgttgagagtgggcatccatgtaggtaacagcagagagctttggggttcagaaaaaaagataagtcacatcccactcaggtaccctaaaatgttgtcttctctagaaatgaaagaagagggaagccagagatgtctgtagcttgcatagttttgggaatagctattctagactttgtcagtgaacagcatagaaggattgttgttcaagcccagttatttgggcaaggatcagattctgttgcttttgttttctggatgctccataatgaatgtgagatagaagcagatgtctcaagtgcttcttgttctcagaaacctcctgacagcagacatctcagtgggcccagaccttcagtgtgtctgtaagtaaaacacaggggagggtgctctttctgatttatcttactattttaatgcaattacaaagcttcctattttctaatatattccaagcctttgaaagacaaggccataaacacccaggatatctgattttattcatgataagacccaaataccaaaatacctatgatcagggctcaccttaattaagtatgtatcttaaaattaaaccaatctcagtttgaggaattcatacttttggaagaaatttattacagtttttgttctgaacattatattatgataggcttgaatagtgtgagccttgctataattacaacctgagtcacaataacttccctgcagaggatgatttaaaatacccaatcaatttatgaactggtcaaaaatgccattctgaggtatttttttttatgcagtctttgcagagaagacatgccatatagtccttcttcattcccaaagcatatatatatatacgtatatacacacacacatatacatatacatataaatatacagtgaagttagtttttacctttgttatcaatattttttatccatcaaaaattttataaatgatttgtggcatcccctttttatcttaggaaaattaaaaatctctctatcaacttatctatgaataaccacatttcatcccttgtgaaatccattttagtttgtgaaactcacatgggagatcttttattttttgcccgcaaggatgtaggctggttaaatttacagagattctttaatgatgataatgtacatttgactgatatcaataagaaatattgatattattaatatcaacattttttgcaatgctaaaaatttacaagttgtcgaattatttaattatttatttttattatacattaagttctgggatacatgtgcagaatatgcaggtttgttacataggtatacatgtaccgtggtagtttactgcacctttcaacccatcatctaggttttaagcctttaaaacctttaagcatttggtacttgtcccagtgctatctttaccttgcaccccatcccccaagaagccccggtgtgtgatgttccacttctccatgttcatgtgttctcattgttcaactcccatttatgagtgagaacatgtggtttttgcttttctgatcctctgtttgctgagaataatcatttccagcttcatccatgtccctgcaaaggacattaactcattcttatttatggctgcatagtattccatggtgtatgtgtgccacattttctgtatccagtctatcattgatgggcatttggtttggttccatgactttgctattgtaaataggaatgcaataaatgtgcatgtacatgtgtctttataatagaatgatcaataatcctttgggtatgtacccagtaatgggattgctcagttaaatggtatttccagttctagatccttgaggaatcgcgacactgtcttctacaacggttgaattaatcgacactaccaccaacagtgtaaaacattctatttctccacatcctctccaacatctgttgtttcctgactttgaatgattgccattctaactggggtgagatggtatctcattgtggttttgatttgcatttctctaatgaccagtgatgataagctttttttcgtatgtttgttgactgcacaaatgtcctcttttgagaagtatctgttcataaaccttacactttttgatggggttgtttgttttcttcttgtaaatttgttaaagtttcttgtagattctggatattagccctttgtcagatggctagattgcaaaaactttctcccattgcctgttaactctgatgatagttccttttgctgtgcagaggctctttaattagatctcatttgtcaatttttgctttgtttcaattgtttttggtgttttagtcatgaagtctttgcccatgcctatgtcctgaatggtattgcctacattttcttctagttttatgattttttctcttatggttaggtctttaatccatcttgagttaatttttgtataaggtgttaagaaagggttcagttttagttttctgcatatggctagccagttttcccaataccatttattaaataggacatcctttcttcattgcttgttttttttcagatttgttgaagttcagatggttgtagatgtgggtgttatttctgaggcctctgttctgttccattggtctatatatttgttttcttaccagtaccgtgctgttttggttactgtacccttgtagtgcagtttgaagtcaggtagcatgatgcctctagctttgttctttttgcttaggactttcttggccatataagctcttttttagttccacccgaaatttatggtgtttttctcctttttttttaatactgtgaagaaagtcactgttcgcttgatgagaatagcgttgaatttaaaaactactttgggcagtttggccattttcacaatattgattcctcctatccatgagcatgtaatgtttttccatttgtgggtgtcctttcttattttcttgagcagtggtttgtagttctctttgaagaggtccttcacttcccttgtaagttgttttcctgggtactttattctctttgtagcaactgtgaatgggagttcactcatgatttgtctctctgattgtccattattggtgtataggaatgcttgtgatttttgcacattgattttgtatcctgagattttgctgaagttgcttaccagcttaaggggatttggggctgagacaatgcaattttctaaatattcaatcatgttatctggaaacagagataatttgacttcctctcctgctatttggatatcctttattttttctcttgcctgactgccctggccagaactttcaatactatgttgaataagagtggtgagagagggcatccttgtttgtgctgattttccaagggaatgcttccagcttttaccaattcagtatgatgttggctatgggtttgtcataaatagcactcattattttgatatatgttccatcaatacctagtttattgagtgtttttagcatgacgttgtgttgaaatttattgaaggccttttctgcatctattgggataatcacatgtttttttgtcattgtttctgtttatgtgatggattatgttgattgatttgcttatgttgaaccagccttgtatcccaagggatgaacccgacttgatcatggtggataaaccttttgatgtgctgctggatttggtttgccagcattttattgaggatttttgcactgatgttcatcaggaatatttgcatgaaatttcatttttctgttgtatctttgtcagttcatggtattaggatgatgctggcctcataaaatgagttagggaggagtccctgtttttctattgtttggaatcatttcagaagaaatggtaccagctcctgtttgtattgttggtagaattcagctgtgaatctgtctggtcctgggctttttccacttggtagtctattaattaccgccttaatttcagaacttgttattggtctattcagggattcagcttcttcctggtttattcttgggagagtgtatgtgtccaggaatttatccatttcttttggtatttccgtagaggtgtttatagtattctgtgttggtagtttgcatttctgtgcgatcagtagtgatatcccctttaatgtttttattgtgtctatttgatacttttctcttttattttttattagtctggctagcaatacatctattttgttaattttttccaaaaatcagctttttgattcactgattttcttgaaggattttttttatgtctttatcttcttcagttctgctccagtcttagttctttcttgtcttccactaggttttaaatttgtttactcttgcttgaatagttcttttaattgcaatgttagggggttgattttacatctttcttgctttctcttgtggtcatttagtgctctaaatttccatttgaacactgctttaaatgtgtcttagagattctggtacattgtatctttgttcttatcagtttcaaagaacttatttatttctgctttaatttccttatttacccggtagtcattcaggagcaagttgttcagtttccatgtagttgtgtgggtttgagtaagtatcttaatcctgggttcgaatttgattacactgttgtctgagagatggttcgttatggttttcattctcttgcatttgcgaggagtgttttacttccaattttgtagtccactttagaataagtgtgatgtggtgctgagaagaatgtatattctgttgattggggtgaagagttacataggtgtctcttaggtctgcttggtccggagctgagttcaagtcctgaatatatttgttaattttttgtctcattgatctgtctaatattgacagtgttgtggtaaaatctcccactattattgtgttggagtatacttaaacacaatattattgtgtttgtaggtctctaagaacttgttttatgaatctgggtgctcctgtattgggtgcatatatatttatgatagttagctcttcttgttgcattgatccatttaccattatttgatgcccttctttgtctcttttgatctctgttgtcttaaagtctgttttatcagaggctaggattactacccctgcttttctttgctttccgtttgcttggtaaatattccttcattctgttattctgagcctatgttttactttgcctgtcagattggtctcctaaatacaatacaccaaagggtcttgacccattattcaatttgccagtctgtgtcttttaattggggcatttagcccatttacatgtaattttaatcttgttatgtgtgaatttgatcctgtcattatgatgatagctgattatcttgcatattagttgatgctgtttctttatagtgtcattagtctttacattttgggagtttttgcagtggtattttggtagtttttgcagtagctgatatctttttttttttctttttttttttttgccccatatttagtacatccttcaggagctcttaaaggcagtcctggtggtcagaaaatccctcaacatttgcttttctgtaaaggattttatttctccctcaattatgaaacttagtttgtctggatgtgaaattctgtttgtttgtttgtttatttatttatttatttatttatttatttatttattttaagaatggtgaatattggcctgcactctcttctggcttgtagggtttctgcagtgatatctgctgttagtttgataggctctcttttgtaggtagcctgctctttctctcgggatgctgttaacattttttcctttgtttcaaccttggtgaatctgactattatttgtcttggagttgctcttctcaaggagtatctttgtggtgttttctttatttcctgaatttcaatgttggacttcttgctaggctggacaagttctcctggataatatcctgaagtgtgttttctaactggttccattctcctactcactttcaagtacaccagtcaaacataggtttgatgttttcacatagtcccgtatttcttggaggctttgttaattccttttcattcattttttctgtaatcttgtcttcacattttattttattaagttgatcatcaatctctgatatactttctttcccttgatcgattcagctattggtacttgtgtatgcctcaggaagttctcgtgctttgtttttcagctatatcatgtcatttatattcttctctaaactggttattctagctagaagttcttgtaaccttttatgaagattcttagcttccttacatggggttagaacatgctcccttagctcagaggagtttgttatttcacaccatctgaagcctacttcagtcagtttgtcaaactcattctctgttcggttttgttctcttgctggtgaggagtgatgatcctttggaagagaagagggattctggtttttggaattttcagaatttttgaactgttttatttttcatcttcatgaatttatctaactttgatctttgatgttggtgaccctcagatgggatttttgcatgggtgtcttttttgttgatgttgatgttattgctttctgttcgtttgttttctttctaacagtcaggccgctctgctgcaggtcagctggagtttattgaaggtccactccagaccctgttttcctggctatcaccagcagaagctgcagaacagcaaagattgctgtcttctccttcctctggaagcttcttcccagaggggtagccacctgatgtcaaccagagctctcctatatgaggtgtccattgaacccagctgggaggtgtctctcagtcaggaagcacctgggttagggacccacttgagcaggcagtctgtcccttagtagagcacaagttctgtgctgggagatcttctgctctctttcaagccataggtaggcacatttaagtttgctgaagctgcacccatagccatcccttactccaggtgctgtgtcccagggagatgggaattttatctataagcccctaactggtgctgctgcctttctttcagagatgccctgcccagagaagaggagtatagagagccagtctggctacagcagctttgctgagctgtggtgggttccacccggtttgaacttctcggaggcttatttacactatgaggggaatactgcctactgaagcctcagtgatgccagacacccctccctgcaccacattcaagtgtcccaggtcaacttcagactgctgtgctagcagtgagaatttcaagccattggatcttagcttactgggctccgagagggtgagatcagctgagcaagacaacttggctccctgacctcagccccctttttaggggagagaacagttctgtctcactgcggttccaggcagaactggggcatggaagaaacaaaaacaaaaacaaaaacaaaaaaaactcctgctgctagctcagtgtctgcccaaatggctgcccagtttgtttgtttgtttgtttgtttatttatttatttattttactttaagttctagggtacatgtgcacaacatgcaggtttgatacatgggtatatatgtgccacattggcttgctgcacccatcaattcatcctttacattaggtatttctcctaatgctatccctccccaagcccctcagtgcctgacaggcctccatgtgtgacgttccccaccctgtgcccaaatgatctcattgttcagtttccacctatgaatgagaacatgtggtgtttggtgttctgttcttgtgacagtttactgaggatgatggtttccagcttcatctacgtccctgcaaaggacatgatctcatccttttttatggctgcatagtattccatggtgtataagtcccacattttcttaatccgtctatcattgatggacatttgggttggttccaagtctttgctattgtgaattctgctgcaataaacatatgtgttcatgtgtctttataggagcatgatttataatcctttgggtatatacctagtaatgggattgctgggtcaaatggtaaatctagttcttgatctttgaggaatcatcacactgtcttccacaatggttgaaataatttacgctcccaccaacagtgtaaaatgttactattactccacatcctctccagcatctgttgttcactgacgttttaatgactgccattctaactggtgtgaatggtatctcattgtggttttgatttgtgtttctctaatgaccagtgaagatgagcattttttcatgtgcctgttgctatatagatgtattcttttgagaagtgtctgttcatatcctttgcccactttttgttggggttgtttgctttttcttgtaaatttgactttgagttgtttgtagattctggatattaaccctttgtcagatgggtagattgcaacaattttctcccattctgtaggttgcctgttctctgtggtggtagtttcttttgccatgcagaagctctttagtttaattagatcccatttgtctattttgggttttgttgccattgcttttggtattttagtcgtgaagtccttgcccatgcctttgtcctcaatggcattgtctaggattcttctaggatttttatggttttaggttaacatttaagtctttaatccattttgaattaatttttgtgtaaggtgtaaggaagggatccagtttcagctttctacatatggctagccagttttcctaccactgtttgttaaatagggaatctttttcccatttcttgtttttgtcaggtttgtcaaacattagatggttgtagatgtgtgtgttatttctgaggcctctgttctgttccattggtctatatatctgttttgtaccagtaccatgccattttggttactgtaggattgtagtatagtttgaagtcaggtagtgtgatgcctccaccttcattctttttgcttaggattgtcttggcaatgcaggctcttttttggtttcatatgtactttaaagcagtttttttgtttccaattctgtgaagaaagtcattggcagcttgatggggatggcattgaatctataaattactttcggcaatatggccattttcatgatatttattcttcctatccatgagcatggaatattcttccatttgtctttgtcctcttttatttcattgagcagtggtttgtagttctccttgaacaggtccttcacatcccttttaagttgtattcctaggtattttattctttttgtggcaattgtgaatgggagttcacgcatgatttggctctctgtttgtctgtgaatggtgtatgtaattgattttgtatcctgagactttgctgaaattgcttatcagcttaaggagacttggctttgagataatggggttttctaaatatatgatcatgtcatctccaaacaggtacaatttgacttcctcatttcctaattgaatatcctttatttctctctcttgcctgattgccctggccagaacttccaacactatattgaataggagtggtgagagagggcatccttgtttgtgctggttttcaaaggaatgcttccagtttttgcccattcagtatgatattgattgtgggtttgtaaaaaaatagctcttattatcttgagatatgtttcatcaatacctcgttattattttgagatatgtttcatcaatatctagcttattgagaatttttagcttgaaggctgttgaattttgtcaaaggccttttatgcatctattgagataatcatgtgcttttgacatcggttctgtttatgtgatggatgacgttcaatgtatatgttgaaccagccttacatcccagggatgaagccaactagattgtggtggataagctttttgatgtgctgctggattcagtttgccagtattttactgaggatattcacattaaagttcatcagggatattggtctaaaattctcttttttgttgttgtgcctctgccaggctttgctatcaggaagttcttggcctcataaaataagatagggagaattccctctttttctattgattggaatagtttcagaaggaattgtaccagcttctctttgtacctctggtagaattcagctgtgaatctgtctggtcctggactttttttggttggtaggctattaattgttgcctcaatttcagagcctgttattggtctattcagattccatttcttcctggtttagtcttgggagggtgtatgtgtccaggaatttatctatttcttctagattttctaacttatttgtgtggaggtgtttacagtattctctgatggtagtttgtatttctgtgggatcagtggtgacgtcctttttatctttttttattgcatctatttgattcttctctctttttttctttattagtcttgctatcagtctatcaattttgttgatcttttcaaaaaaccagttcctggattcattcattttttgaaggattttttgtgtctttatctctttcaattctgcttggatcttagttatttcttgccttctgctagcttttgaatttgttcttgcttctctagttcttttaattctgatgttagggtgtcgattttagatctttcctgctttcccttgtgggcatttagtgctataaatttccctctacacaccattttaaatgtttcccacagattctggtacattgtgtctttgttctcactagtttcaaataacatccttatttctgccttcatttcattatttacccagtagtcattcaggagcaagttgttcaattcccaaatagttgtgcagtttcaagtgagtttcttaatcctgagttctaatttgattgcaatgtggtatgagaaacagtttattgtgatttctgttgttctgcatttgctgaggagtgctgtacttccaattatgtggtgaattttagaataagtatgatgtggtgctgagaagaatagacattttgttgatttggagtgtagagttctgtagatgtctattaggtctggtttttgcagagctgagttcggttcctggatatccttgttaacctcctgtttcattgatctgtctaatattgacagtggggtgttaaagtctcccattaacattgtgtgggagtctaagtctctttgtaggtctctaaggacttgctttacgaatctgggtgctcttgtattgggtgtatatatatttacgatagttagctcttcttgttgaattgatccctttaccattatataatggccttctttgtctcttttgatctttgttggtttcaagtctgttttatcatagactaggattgcaacccctgcttttttcttcttcttctttacgttttttttttttttttttttttgctttctatttgcttggtagatcttcctccatctttttattttgagtctatttgagtctttgcacgtgagatgggtctcctggatccactccagacgctgtgtgcctgagtatcactaggagaggctgcagaacagcaaataattctgcctgattcttcctctggaagctttgtttcagaggggcacaagccagatgccagttggagctcttctgtataaagtgtctgtcgacccatcctgggaggtgtctcccagtcaggaggcaagggggtcagggacccacttgagaaggcagtctcttccttagcatagctcaaatgctgtgcctggagatccactgctctcctcagagcagtttaattctgctgaagctatgcccaaagctgtccctttccctaggtgctctgtttcagagagatggatgtttttttctataagtccctgactggtgctgctgcctttctttcagagttgccctgccagtgaggaacaatctagagaggcagtctggccacagatgctttgctgcactctggtgggttctgatgaaatttcgggctgcttttttttaatctgtgaggggaaaacctcctactggagcctcagtaatggcagacaaccctccccctaccaagcttgagtgtctcaggtggacttcagagtagtgtgctgccagggagaatttcaagacattggatcttagcttgctgggctccatgagggtggaatctgctgaacaagaccacttggcttcctggcttcagcccccattccaggggaatgaaaggttctgtctcactggattatgaaaaaaaaaaaaaaaaactcctgcagctagctcagtgttggcccaaatgatcgcccagtttcgtgcttgaaaacaagggccttggtggtataggcaccttagggaatctcccggtctacaggttgtaaaaactgtgggaaaaacatagtatctgggctatgtcacagtccctcatggtttccatttgctaggggaggaaggtacctgtcgccgtgcacttcccaggtgagtcagtgccccatcctacttctgctcaccctccatgggacacatccactctctaaccagttccaatgagatgaactgagtacctcagttggaaatgcagaaatcacctgccttctgatttgtctcactagaagctgcagaatagagctgttcatatgtggccatcctgccagatcctccctaatttatatgttagtatattttcacacacactcacacacatacacacatacatggcagcactaaattatattctctaaatgtacctacagatacttaatcatttgcacagccactatcattttatgcttgatggcttagacaagtaactctcacttgtgggtggttttggccaccaggggtcattcagcactgtctggagacattttccacagttaaaactgggtaggaggtgccaccatcatctagtgagttgaaactgggaatgctgcaaaataccatacagtttagaggcggcatctctacaacaaagaatcatatggttcacaaatcattatcattgtgctgagatgcggcaatgctgagcttcagactatagcaattttttgcaaatttgctaaatttcaaaaaatgaaggaataaaaaaagatagctctcaacctgtgggtattgtgaatgcctaacttagacttaggaagcgtacaggtgcccttgggcttgtcttctttgtctgctgctagtttataattgttcactgcccatcaggaccttgtgggttatagatttagatagaggaaggatttgatcatacaggtgggtcagtcataaccaatatgtgagtcacagtctcactcacattgagtttgagaatttaaggcatgggctggaattcctcatggaactgacattataaacctgggaagaaatctacccactgaattccacttgagctgtctgtttcagcaactgttcaatactttgaggttacatactatctcatttaatcccaacctgggatagtgtgtaataccaaattctttacagctacatgggattaaattaggtagtatgtgaaattccaaatagtaaattggtaaagtgatgcctaatgaatttgaatgagctgctgccagcctacttagtactaacagtgagctaatagcaccttgtgtccctgtacccagaagtctttcttgcaggactgtagcgaacatgtcagcatgttgtctacgttgactggacatcttctgttctcttcagcctttgcctgtgtatgctcctgtcctgctctgcacaatttaatgaagcaggtgggacacactagtttacccttttagtagtctgcatagattgacttgcttccctcagttcacagagatagcttcccaggatacagatttatctgaattacaagttgatggcttcattgttcacaatagcaaagacatggaatcaacctaaatgcccatcagcggcagactggataaagaaaatgtggttcatatgtaccatggaatagtatgtagtcataataaaagaatgagattatgtcctttgaaggaatatggatggaactcgaggctattatccttagcaaattaatgcagaaacagtaaaccacatacttcatattctctcttataagttggagctagaaatgagaacttacgaacacaaagaaggaaacaatagaaaaaggagcatattggagggtgggcagtggtaggaggtagaagattaggaaaaatatttattgggaatgaggccttgtatctgggtgatgaaataatcagtacaactaatgcctgtgacataagtttacctgtatggcaaacttgcacacctacccctgaagccaaaataaaagttataaaaaaggtgatggtctcacctattctcttggggaaggctccaaaagtaacagctacctctagttaaaaatcttctggttaaaaaaagaagcaaccaaacacgacatcactctttgtttttcttgtctgtctcttaattattcagaaatgggattgctgcatggcagacatccgaatgttgtctacagtacaattcagagttagtagcaaacacctaaatcagccatttgatgagatgctatttgtcactttcaaagttacaatccagattttcagtgcattttcatccaactctgttgaacttttcccaggatgtcatgtactatggaatttccccccagtaggtattattgttctgtgatagatccagttccaatatgttttattaaaaagaaaaagccatgtgatgtattttgttcaattgattacttaaatgaaatggataactattttctgatgcaaatgctctgagtaacccacaaattcctcagaaacacatttgcatactttgagatgaagaacactctaaatgcaccctccttgtgacacctagtgaaacgttttctgtccctagaggatcatttgacatactgtccattgctgcacaacattcttttattgtcacaggagcagcgatttccctagggatagtcatattatccttgtagggaccaattgaggtggtgaccctttaaaagttgactccagtcttaatgggaaagtaactcaaatgtagccttagatttttaaatgggatacagggtgaagaggataccctctcaggcatgcagcagcttactgcaaagtcaggataattgcatcaacacttttagttatgaaagaagtcttcaagagaccagcactgaagcatgtacttgaaatgcaccatcttgtacagttttttttttttttacaagaaactgagattcagaacagtgaagtatgtagcctaaatatatatgtgcacttgagtagaacaaggaaaattcgtgtccaaagtctacactcttttcatttgatgattttccccttgtggcctgataaatatccacatcacaatgacaggatggcctggatgcatgcttctattttgctcctactggaaaacttttagatctgcatgcatatccccttaggaaagagtgaaaattgccttaaacatttgagaaaaagttcttttgataacccgtctggtaaacaatagtgaaattggtaggtgtcattattatcacttgcataacctgtacaattcttgaacgtcggtttgttcattcaacatagatgtgatgagtgttttctaaatgtcaggcattgtttctggtgataggatatacagccaggattaagaaaagtgatggacactaggcatggtgactgacgcgtgttatcccaacactttgaaagtttgattgaggaggatctctttaggccagcctggataacatagagacacctatgtctacaaaaattccaatgaattgcccggacatactggtgcatgcttgtagtcccagctactcgggaggctgaggtgggaggttggctttagcccaggagttggaggctgcagtgagctgtgatagcaccactgccctgcagctttggcaatatggcaagacaccatctgtaaaaaaaaataataataataaagacaagttatgtttttgctattgtcgactatgtggagatggcactatacacattcatatacaaatgaataggaatttcatagagagatgttgtggatttcatggaagagccagccagtgttctaggtgatcattgtgtggcttcattattcttgtctgctttctccctcctttaggttgcattggagttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggtgagtacctcactggaacagaaaacaatacttcttgtgcagtgtgtggagagatttaccaggagggttttataatgtctcttgcatgatcttttctataacctgtttattttattttaatttatttttcatattccaaatgcaattcttgcagcagcttaccacatgttccacttgtatatattgggacatctactggatggacaaaactataaataatgactttattttcatatattacctaattaatgttttataattttatttgcagatgaaaattaacatgagcatatagtgttgcatgttatacctgaatcatctgtaaaggaatgaatccatagaaaaaataatagaattaagtacactaccatgctccagtttacaaactgaaagatagagaaaatggttctttctgccataatgacttgagatattagcaccttttttgagttttgaaagaaaaactttattttttttaatatacaagcatgaggtagttcatacaatgataggatttcattgtttagaatccattttcttaatgtaaatttggactttgttttcttccaagatccactacgatcaaatgacaaaatatagtcagatgattctagctacattagacgtgatgtgtttatatttttaaaaatttcctcttttttctataaaacaccaatgaaagtctgtaaacacaaaaacatttaatatattaacctaatgttagtaaaacatgaatagttttatgtctgtatagatttcaaattcagatttcctcgaagaataaccaaagttatgccacagtggtatcatatttcccggttagcatttccatatgccatttttagatgaggagaaaggacaacagagaacaaaatatacctggaaagaaaggaaataatttgtgagaataatagacatatctaatgtagaaactagagcttgtcttttgcataaagctcttcgtggagaatgtgataaatttcttttatggagaatttttttcttctcattgttctttacactttaatacctggaaaatatttttcagtaaaatttggctgaaagtattaaataaacaattacattaattcattgatctccaaaattatattgcatctgtcagattactctctctccaggtaattgctagttagtctaagtagagcgtcattaaaaactagaccagggttgtgtgccattgagattacaaattgccattgagattacaaggaacagttcagagtaaaaaagtaaaggaccctgcttcatcatattagtggtttctagaatattgcccttgtcattagggtgacagatctcccaatcatctcataaaatccaggtctgaatgtgactgaaggagtcaaactgacgtttggatgctgtacttccatggggtgttctgtgctgtctctgtgcctaatagtcccctttgtgcatgtgtgtgatgagaaagagctgtcaaaatctattagggttctcatttgagcagccacctgggttgagatctttctcataaaggaactattcaaaccaaaagtaaaaagaatggaatacaaaaattcagagaaaaaccccaaacaggacaaagtattacaattgcttttataatacattggatatgctagagtctaggacctggtgattttatagagctagccttggcaacaatgaatgcacttcaaataggatgcctcctcatataggatgttggatggaatgagaccacccatgaaaaaaatcaatagcttccatgacagcagagccctgtaggtacaattgtgtggatggagaccacaaacagggtggacgtttcattgtgattcagtattgaattgtaatttggggagtataactctgtgaaaaatgctattcagtgaaaaagtaatccaaatttcataataaacccagttccacttctattctttagtctttttgaagcaatatgcgcatacgatcttgaaaagggaatcagaaatttaatagtgactgaaaaggtagaataaatctccccacaatgtgtaaactttaaaattttgcttgtgagagttcaaagctacagccctgcatgtttacacaaaccacaagtcacagactatcgagttaggagggttttttgtttgtttcctcggttgtttttgtatctctatcaactcgataggcaatacaaagacttagatatttaattattgttcattcactaagtgaatgaactctgcattcataacaacctactgaaatgttggcatcacgctgattctctccaaaggccttctcttaggcagtatctgaattcatatcagtgcttttgtttagcaggatagaaatattattatctggaattcagaattctactctgaccacttagaatctctactttttttgtttagctttgtctttctgccttgatcatatttgctaaaactttcacattcttaatttcataaaatgtgtacatttattaaaaatgcaaaaacagactttatttcagttaagtacttattcttaaatttaagaaataacttggatgagaagtgttggacatttctttgtagtacaatagtttcatgaaacataaattgtttttcggtagaaagcagtattttttataattcccttcaaataaatcacatcttgctgaagttgagtcttttcgttcaaattgtcatcatgatctactaagcttagtcttgagtctttatacctaattacaaatttctatatttgtaattagctatgccatacaaatttatttagattttatatattataaatttctttattgtctagatgacaggttaattaacttaaattgcatatttaacattttgataggtgctcaagtaaggtcaaaatcaaagccagtcagaagctctagtaggacacatgggatattgctcacaaggaagagttggagaccgcatccgcatggtgtgtgtgtatgtgtgtgtgtgtttgagagtttgtgtctacatgtgtcagagagaaagagccagaggaaaagagggggtaactgagtgactattttgaagaagcagtgcagaatatggcttggtagcttgattaaacaaaactgatgaaagtcaagctgagaagttccaatctcacatactaagttcatgtcagttcatacatgagagcatggcactacaatttgagacttctcttggtcaccaaggagactgaacacagaaagacaagctatggaaacgcttcaggtttttaatgagaacccttggtattgaagtgaggttaaaaagtaacggaaaaataaaagacacattttgaagtagttgctcacacaagatattgtattaaatataaagcttggaagagaaaaagccgtaagttgagtccagggtgtcttggggaatggacagagccaaggaaccacttccggagtgatttacacctgtgctttctctctgtatccttggacatacatcttaaggtcttattcttgaatgatttcagggcaaaaagcccttccattcttcataaaggtgtgtccggaattggtgggttcttggtctcactgacttcacgaatgaagctgccgaccctcgcggtgagtgttacaactcttaaagatggtgtgtccagagtttgttccttcagatactcagatgtgtctggaatttcttccttctggtgggttcgtggtcttgctgacttcaggaatgaagctgcagaccttcgtggtgagtgttacagctcttagaggcagcgcgtctggagttgttggttccttccggagtagttcatccctcccggtgggttcctggtctcactggcttcagcagtgaagctgcagaccttcccagtgagtgtcacaactcttaaaggcagcgcgtctgcagttcttcattccttcctgtgagttcgtggtctcgctgacctcgggagtgaagctgcagacctttgtgaaggtgagtgttacatctcataaagctgcgggacccacaaaaagtgagcagcagcaagatttattgcaaacagcaaaacgaccttccaccgtgtggaaaaggacaccagcagattggcgctgtgtgctttgggcagcctgcttccattcccttatctggccccacccacattctgctgattggtccattttacagagagctgattggtccattttgacagagtggtgcatgtacaatccctgagctagacacagagtgctgattggtgcatttacaatcctctagctaggcataaaagttctccaagtccccaccagattagctagatatagagtgccgattgctgcacatacaatcctccagctagacgtaaaagttctccaattcccagtcagcctggtgtctcagcctgtgatcccagcactttgggaagcgaggtgggcggatcacgaggtcaggagaggagaccatcctggccaacacattgaaaccccgtttctactaaaaatacaaaaaaattagccgggtatggtggcacgcgcctgtagtcccagctactcgggaggctgaggcaggagaatggtgttaacctaggaggctgagtttgcagtaagccgagatctcgccacagcactccagcttgggtgatagagagcaaggctcaatcttaagaaaaaaaaaaaaaaaaagttctgcaattccccagccgactcaggagcccagctggctttacctagtggatcccgcgctggggcctgccagtcccgtgccccgcgcctgcactcctcagcccttgggctgtcaatgggagtgggccctgcagagcagggggcggtgcccgttggggaggctggggctgcgcaggagcccaccgttgggggggctagggcatggcgggctgcagatcctgagccctgtcccacagggaggtggctgaggcctagggataattggagctccaagcgggcgggccggcagtgctgggggacccagcgcaacctccgctgctcctggcccgagtgctaagcccctttctgccctggcctgccactccgagtgctgcccgcggagtgggggcccgccgagcccgggcccacccagaactcgcgctggcccgcaagcgccgcgcacagcccagttcctgcccacacctcttgacctctccttccacgcctcaccgcaagcagagtgagcgggctcccgcctgggccagtccagagaggggctttcatagtgtggtgtgggctgaagggctcctcaagcgcagctggaatggacgccgaggcctaggaggtgcgagggagggctgctagcacgttgtcacctctcaatgggactgaaaaccctgggaaatataaagaaaaaatataaatggaagtcattattgcccaggtgcggtggctcatacctctaatctttagtaggcggaggtgagtggatcacttaaggtcaggagtttctgatcagcctggcctcaggaggctgagacagcggaattgcttgaacctgagaggcagagggaggttgcagtgacccaagattacaccactgcactccagccttcgtgacatagtgagacactgtctcaaaaaaagaaaacagaaaagaaggaaagtcactatcattgtcttttcattgtaggataacagcaaatgccattgtgatttctagagaagtgaaattctgtttttgtttgtttgtttgttttgctagcaatacaatcgaaaaaggaagctatttaaaaaagagcagataattgaatgcaaggtgtccctatcatcttttttccccaagatgaaacctgcgactttgaattctattacttaagtaaacatgccacgattagtgattgaagacctattcggtgaagcttggagctttatgatgaaatataaacagacgtgacatggacattgacctgtagaaatttggacagttagtaaacgtagaggtagatgataagccacagcatcctagtgaaggaacaaagaaagttctgtgacagctcagggacaagttatgttttgaggaaatcttgatggaatctataaatggttgagctgtgtcctgaagaatatttgggctatagaagggattcatctattaagcatctgttgactggaacttttgaacacacaaatctatgttaagcagcttggcgccaatcgttgctgttgttactacttgggtgttaagtgtggcatggtaacagaagctctgctttaccacgtgctctttctgtcagtgccatataataaaagttattttatttttattcttatttttttttatttagagacagggtcttgctctgtcacccaggctgaagtgcagtggtgcaatcgtagctcactgcagcctcgactttctgggttcaaagaattctttcatctcagatttctgagtagctgggactacaggtgcactccaccacacctggctaatattttgattttttattttgtataaataaaaaatttatacaaattgttgctctggctggtcttgggctcaagtgctctcccacctcggcctgccaaaatgctggaactactggcataagccattggactgggaccataaatgtttttatgttatccatagctgctcaccatggcactttgtggggtagacaagctacctaagatgaaagggtggcagatgaacgacagggaaagaagctagaaagtcaactggctttgctagtgtttttacaaaaaaatgcattcgcttcccttgtagacagcactggatgtaattcaagatataatttatagcacggttttcatccttgaatatctcccatcttttcaggaagtcgtacaaacttttctggcattctgcgttagtgaaagggtgttggactatgtccagctggtagaaaataacctagcctcaatctggcattgagggaaaaattgaaatttattagaagggtggtgagatatccaaatttactgcaaaagtcgagaaatcagattgggagaagggcagatatgcagctagactttagaggcacctggaagaaatgagttaaaggacatcaccaatcttatgtctggttctttgcttctttctggaaatagacttgctttacgtggtgagtgagagggttctctgcagttttcactacatgcattttgtttttctcagtaccaccagtgaaggacaaagttccataattccatactaaaaatccctgggcagagttttaattggctcagttgacgcaatagtaagaagtgataaaactgggctgctcctgggtataacagttggcagggggagaaggacagttcttaccacaaggtgtctggaatgagcaggcactgcttcacttcactgtccaaaatatttttgaggagcagttatatgccaggcaagctttagaggctgagatttcaagtttacaagcatttctaattttgagtgataggtacttgtaggcagaagaatcatggtccttgagagatgtgcatggccttcctcctcccttcacctgtcattgctggaacctcggaataggttgctaggcatggcacctgacttcttcaatactctgccttaagtattgacttcaaatggcaaaggggaattaaggttgtagacggaattatgtttgctaaccagcagaccttccaatagagagaattatcctcagttacataactgagcacggtatattaacagaagccctccaatgtggatgcagaaggctcaagaggagatcagagttggagtaaagcagcatgtaaaagagatacctggacattgctggctttgagtatgagagagccaggagaaaggaatgtaggcagcagcgtttggaagctagagaggcagggaaactgattcttccttagcgcttccagaaaggagcccaacagccctgctgacacctcaattctatccccatggaagaaactgtctcttggaagaaactttacctctggaagaaaccctagccccatagaagaaactctgaagaaactgtaaaagaataaatgtttgttgttccaagcttactaaatttgtggagatttgtgatagtggtaatagaaaactaaggaagagttttatcaccctttaatatgatttgaaattcataatgaagtattactctgaaaacgaagttcagagtcactgaagtcattaggttttgagccttctgaccccaagtccgttctgggattctacttccaataatttctagttgaaaacactcttgggcacttggagctttctgtcttcctcaagaatgtcgaggagacaatacagatgactcttttagggcagatatttttcagatttttaaaaaatttctcttctaaactttgagtgagagttaccctgtccctgagcgggatcttgcactgttacccaggctctagtgcagtggcacagaagctcactgcatcctcaaattcctgggcacaagtgattctaccacctcagcctcatgagtgtctgggactacaggctgatactgtattaagcttcagagaagaagcatgtccaggttcctgcaaattagaaaatggtagcagatatatatatttttttttcaagaaggagttttgctcttattgcccaggttggggtacagtggtgtgatctccactcacagcaacctctgcctcccaggttgaagtgattctcctgcctcagcctcctgagttgctgggattacaggcatgtgccaccatgcccagctaatttttgtagagatgaggtttcaccatgttagtcaggctggtctcaaactgctgacctcaagtgatccacaaagaaacaatgaaaaaaaaatcccctattagatttacattacaattttcagccaccatgactggctagtttttaaatttttttaaagagttgtagccttccaggctggtctggaactcctagcctcaagtgatcctcccatctcaggctccagaattctgggattacagacataagccaccatgctcagggacattctgcaaatttgacattttgcattaggttaatatagccccaaggcaaattgtcctaaacagcatattccacagatacactattttgacacaggaaagtaataaagggtcatttaaattttttttcagacagctatgacagatttccagagatgatggctttgaatgacttataacaaaatacccaaatggttctttcatcatctgcctccatagagtttcacttgtgatggtggctgcacctttacatttcttattttcctacttacaaacactgctgacaaaatcttctgagctctccattccttccagctacaacttaacctgtggtctctgctgggcaaagtgactcaccttttgaatgtacgccttgtttactcctccagccaaaacttgtttgctggagttggaatgccagtttatccccttagcagatcattatgggcaagtgactcagctttcatgggacacagtgcccttatgtctaaaatagaggtagctgagaggtttaaggttataatccatataaaatgcttagtatccagcacatacaagcaccctgtaatctgatgttagtgcaatatcagtaataatagaaaacagaacttgacaatttcagcaaaattgcatgtgcatagtgggtctggtatgtgtattaatccaggcataataaatgctgatcatctgtgacatagctgtttactgttgtagtggaggggtaagctgaagaggtaagaccaacagcccattatttctggtggtttctagtatggttttaacaaatgggaatttcaggaaaagtaacactttttaaaagagctgactgttatcattctgctttattcctgattttagtctttttgagctcctgttgtcaaatggattttgagcatatgtgaattagataaattattcaccatgaaaggattagaataacattttggaaaatgcccttaaactatcaagtggcaataacactactctttgtgtgtgatattaaagagaaattaattctcattttcttgttgtctagacacacaaagtccaattgtatgcatgtaatcacaaaatctaggtgaaaattgaaaactatgttaacagagtgagaccgatgttttaaccaatcaacatcgacatgcaactaggtgacaattattaaattactccagttttcatctgtcagtttgatgtttgacattgtgtagacatagcttgccagtaaagataattatgaaagattattaaataaagatctccctgacatggattaattgaaaagtatttagtattttttttaagcacagttaaactggggtggatttctgatagcatgtttctctcccagcacaaaaagctttcagcaatttgaatattgagtaataatcttattgagggtttggaaattatgtgtgttttgaataatattattggtagtatttggtagtatgaattatgcctgtttgaataattaagaagtagcttttcctaatgaagaacattttccattacatacataatcttccagtacatgaattttaattcaatttacaatttagattcttgtcataatttgaacaatagattacctagaatataataaaaatcaaattttcatatagtacatatcataatttttatcttagaaattgtcagagatagaaactttaggtacatctagtccattggaatatttggccatttaaaacaattagctttttatttatttgtggagtcttgcttcctaagatgttgtagtctaatttttgtcaattaatattgctgatttgaatactgttatttattttggatactactttagccaagctatttactatttattcattttttattttggagacatagtcttgctctgttgcccaagttggagtgcagtgtggtgcagtatccacaacctctgtctcccaggttcaagagattctcctgcctcagcctcccacgtagctgggactacaggtatctgccaccacgtccagcaaatttttgtatttttagtagagatgggtttcaccgtgttggccaggcttgttttgaacttctgacctcaggtaatcagcccaccttggcctcccagagtgctgggattacaggtatgagccaccatgccttgcctagccaagccatttaaacttttaaatatttagtgtcatcacttattaaaaataagactaatatgattataggtcctctgatttttttttagaattatagtgatatgggagtaaataaatatatacgaaataattataaaatagaaaagattagtgcattcttagaactttaatgtcatgttaattgaatgttaatccaatgactttatctttcatttcaagattccttgcctgaatgaagtagtggaagcccttgttgacaataggtcctatcttcctattccgctttttggttttcctaaaccaggttgtttacataatgactaagtttaacattttctctttatgtttaagcatctctttccttggtgcaatcacagccaaactgcagtgaaaacaaacagaaattgagaggttgtgagctccagatttcagagccacagagagtttgtgagatcaaaaaataaatttattgtgaggtcaataaataaattagacctacctaaatcacacagtcagtttaaggcaatggaaccagagggaaagactccaaaagagtgacctatctatggaatagctactggtaaaatgaagcaacaatgagacagtgtagtctccaccttattatttcaatctaatgttctgtattgaggttcagagaagcaggtccaggtttccacaaattaaaaagtggaggattgctcctgtaatcccagtactttgggagcctaggttggggcttcgcttgagcccaggagtttaggccagcctgggcaacatgactaaaccctgtccctaccagaaaaatgaaaagagttgggcatggtggcactggcctgtagtcctagctacttacagggctgaggtgggaggatcacttgaggctaggagatcaaggctgcagtgagccaagaccacagcagggcactccagcctgggtgacacagtaagaccctgtatctaaaaaagaaataaaggaaaaatatttccctgttagattttacatacctgatgatgactttaatggtgaaggtaagcattggtgtgtgtgtttgtttgtgtttgtgtgtgtgtgaatggtgttgaaggaagcccataggaaaagtacccataatttattcaagatcaagtatgttacagttttcttggcaaatgccaagttataaaacacataaaccactctacaacctcttcttccctaaaaccccaaacatcttgaagtctccttcaagccagatatcctcttggtcctctgtgcaagttgtctgcacagtcctcaggtttgtctttgggtaagtccctgttgccatcacaaagaaagaacacagcaggtattgatttgtctcagacaaaggagctcttctggtgggtttcaacaagatatgaaaattctaggttcatgaacactccctttttcttccttaaaaataatatttttagctacattctactccactctgtcttttatgacataatcattcactcaaccagggaacacccactatttgcctaacatcctatctgcctatcacatatggactttagcctccagttagaccaatgatgctattgatctcctaatcccaatgtatactctttggatattttcatctcttttccattgcttattatctttagagacattttaggtagctcatttaaaaattattaataaataaatcattatttgcaattagcatagacaaggacttaggtgagtgttaagtgggtatgcagagagatctaaccccactgctggaaaaagtgagtgggaaagtcccattgatatgtgacccaactaaaccaacattctataaaaagcacaaagccttcagcgactgctttaggatttcaggggaaggaaaatggaggcaaatgtgaaagttgagttgatgtcttcatttctttttcttttcttttcttttctttttttttgttttatttatttatttatttatttatttatttatttatttattttttgagacagagtctcactcttgataaccaggctggagtgcaatgggatgatctcagctcactgaaacctccacctcctgggttcaagcgattctgctgcctcagcctcctgagtaaccgggactacaagcctctgccaccatgccctgctaatttttgtatttttagtagagatggggtttcaccatgttggcccagctggtctcgaactcctgacctcaggcaatccacccacctcagcctcccaaagtgctgggattacaggcgtgaactaccacacctggccgaaagtggatgttttctgtggcggttccttgatagaaaggttttcatccagtcttgagatgaatatacagagtgtaaacacatggttgtgcagtgaggaaatgctgtctatgtttcctaaaactgaggttcttgtttattgcttctttagctgcacaaagacataacacatgcaaaattggggagaaaggagagataaaactatgacaaagctggaggcaatgtgcaatgatgttgtaatttaacatgcaaagtactcactttagtattttttacattgttacactgtgacattgcaggattcataagtggaatttcatccaaatttattctaatgcatatttttttctacttagcagactatacaatatggttaaatcaaagaacatgaggttttgttcttaccaaattcaaaaatactttttatcacctgttgtttaaatcattaacacaaaagatttcagtctcccacaaatttctaatgtagtaaaatcctttcataattttatattcaaaatatattaattcagatgactagtatgaaatcaatgaaatcaagttataatttgcatgtttctaaaatgtttaaatttaaaaatggaaaagtaagccctaaaaaactgcaggtttctcaagaatattaaaatgttaacaaattatttaattttgagctaaaatcagataataatgggaacagatttcaccactgcacattctacagggatgtttgcattttatacttgttttgttttgttttataggaggagattttggtatattaaatataatactagacatttacctggacataaatggtagaatcaacttagactctaatcacagaatgataacatcttccaagtagaaggagcttttggggtcatttaaccaaaactctttcaccttacactatttccatgttcatgttaaccttttggtactctaagaagagatgaactatcatttcttaagttctagaagttgaatttaattatgattttacaaatctgccatctccagtagatggtaaatgctttgaagacccagagcatttttgagataaaataatgagttatatattttattgcatgaaacaaatgaatgaacctgtaatgcctggccaccacctattttttttgaacctgaacaatgaagatgtttgcggctttttctcttcattatgggttgagagggtaggggagggatataattaggagaaatacctaatgtaggtgaaggattcatgggtgcagcaaaccaccagggcacatatatacctatgcagcaaaactgcacgttctgcacatgtaacccagaattaaaagtataattgaaaaaaggcattaaagaaagggaaaggttggtgatgtttacctgagcactctcacaaacagagatgaagcagttttgaatgttaccttcctcttctaacatatagttctgaaagtcttagaaaacatgttattttattccttccaggtagtcttttgcaagcatcctcctcagtgtcaagcatttattctcatgcatcccattatgtgttatgaatacacccagagtttatgtgaaatttttttattttttattttttggcaaatgtattaaactcttggtttgtatattttgaactggaagccacatttttgtaatactttaaaagcaaaatattttataatatgctttagaaattaaaagaaaataggatacctccatttcctatgacaaactctcagcatacagcaaggcaaagctatttgctgctgaagctcaatttttccctgcagatgctgaatgtacaagaattaacagccaagccaggaccctgtttaccttatgtttccctgaaatgccaagcccatgaggtgttacaaggagggaagacagcatacaaacatgatagaatgactaataagctaattggtttatagttttgagaaagcagttggttgcctatgttttttttttttttttgtgtgtgtgtgtgtgtgtgtgtggtgaagaaatatttgtatttcatttaagtgcaactaatttctatttaaatttaagctgccatatgtatctactggctatagcattagagtgtttagccttagcaacctccttattactatatactttttctttttctttctaacactttttaaaatatactttaagttatgggatccatgtacagaacatacaggtttgttacaaggccataagcctgccatggtggtttgctgcacccatcaacacgtcatctacattaggtatttcttctgatgctatccctcccgtagccccccatacaccaacaggcctcagtgtgggatgttcctctccctgtgtccatgtgttctcattgttcagttcctacttatgagtgagaacatgcagtgtttggttttctgttcttgtgttagtttgctgagaatgatggtttccagcttcatccatgtccctgcaaaggacatgaaattatccttttttatggctgcacagtattccatggtgtatatgtgtcacattttctttatctaatctatcattgatggacatttggattgcctatttttaaatgcagtgagctataatttgattgaatgcagaaggaatcatttccaagaaattaaagttcgaaggttggaaaataaccgagttcatcgttagggaaagcttattctaaaacttcggataaaatgagcttcctcttacattttattcaacttaagatcttgtagttacttataatcatcattatcatcatcaaaaacatcatcagaatcatcaccatcatcattatctaaatttgagtagccatcagaagatattgtgagttcctgacttgagaaggattaatttctttgagattttatactgttattttaagactgtggagcatgggttagatctgtgttttaaaaactttgacagaccacattattggtaatagttttctcttagcatgggttttgagttgacttgtgttacagttgaattgtgcgtctcaaaaaaaagttatgttgatatcttaacatctggttcctaggaaattcaccttatttggaaatatggtttctgcaaatgcagtcaagttcagatgagttcatactgtgttagggaagattctaaacccaatatgattagcgtccttgtaagaagagacagacacaggaaaggcagagccacgcgcgggcccagccctgcaaatctctagaaggtgacgatattctttaaaacacttcgaaatcattggaagaaaattacaactgggctctgcctcctggcctggggatgtaattagctgtatagaaaacactgtgataacctactaaggagagtagcctatcaagaagctcaggtgtttggcaatcaactcatttctccaaatgcacaagtgaagaaggcaactgtttttctcaatcctgcagcttgcaaaggcaaagccagaacttgatttgaaaaaaatgctgccctgattttacatatatccaggatggatatgtctattattagggcaggttatgagggataagtcaaggaactcctggaactgatgttaaacacagttgtgatcattgttgtaagaggagatgggacactgaaggaggatgttactggagttcttcaaagaacagatgaggctaccttcagtaagattcccattggatttatcccactgggacggaccagtagtttgagtcataccctctttgctgaacgtggaaacaaagtccaacatataactgatgccacatttgccattgtgaaaggaaagacagttccacttgatgtcttgcagatgcaaggtgaaaaggaatagcctgtgtttgcagtgactggccttcgatggggacccttcagagatgttggcatcaaagttagcaagtactggtatcttgcgcctctaaaaatcaaagcagctcactttttcagcactctcaaagagtggcctcagactcaccaagcctatattttacacacggcacctacagagagatctcccagtgaaccagaatagacccctgtgcaaaggccttctttttacagaagaatattacaaagtcttacatcctactgggcacaaccggagcatgccctttcccaagatgtgagcccagagatctggaaagatgtgcagctgtccaccattgaactatccatcacaacacagaaaaatcagcttgacctgccaagcgaagaagattttatgaacatctgaattgaacgaacaccatcagcaaaggagactttataactacaggaactcgaaaggtttgaaaccgcaagctgcacatcgaaggcacagtgtctccaagccagccagtgcactttgcttgttgccaatggagctgggggctcttttggcatagacagtgaagagtgtgatgtgaagcctgtggaggtgaaactgctccccaggaagctgcagcttttctatgatcccaggaagagagaatagatgctggcaagccccacccagaaagcaggcagaagacaagtgctctgagaccatactttaggccaccagcaggaccaaaagggaacagatgcctcaaccatcccaacagtgttgtcagagtgtcccaagggctttttcatggcaagtagcctctggccttctccagcagtgcttcccaaagtatactctgtcacctgttttgcaatcaggttttgttagggcatattttattttggtgtgatggttgaccctcctaaacacggactttcctcagactggttcaagatggaaaaggactttcttctgttttctcccaaagtgcaaccacagtgcagagcccacagtgggcttaggctgcctgggcctttccattctggttctgtcttttgaccatgctcagaattctggggaaaatgccttccttccctggtgaccttttcctgtttctaggcttctccacaagtgctgctattttgtgagctctggctcctgtttagcttttatatcagttctatcctcagtccagaaatgtatatgaggttgtgtcccccttcagccatggcaacaatattgtaaaatgctagtttttatttttttaggtagtgctttctaaatggtttgcatgagagctacctggggtacatgttgaaaattgatttatttggagtccacaccaaatctaataactcattttggggataaggcccaggaatctgcattttttaaaagttggccaccctttccaggtgattctgtaagttgtccctcaatgcacttggagaaatagtgttttaaagcagtggtccacaaagtattctgcttgtgtgcccccagaagtattttgaaaaatcatgtattcccttacccatctaagttgatatctaagattgttcatgggacattaaatagttgacataatttgtatttgctgctttcacgtaaatattggtattttaaaataaaaactgttatatcaaaaaaaaagaagaagatatgcaacgacaaagacaaaaacaaggagaacaccatgtgaggatggaagtaaagattgaagtgattcatccctaaactagggagcactgttgaaaactatgaggaactaagaacagaagcatgaagcatgaagcacaatccaagacagaagcatgaaatggattttccttcagagcctctgaaaggaagcatcttaattttggactctgctccagaacagtgagagactataagtttttgttgtttcaagtcagcaagtttgtggtaattagttacaaagtcccagaaatgaatgcagtctggattaggtatattctgtatatataagctgcctaagaatgccagaagccagaagaggtggtgtctgcatttctggttcctaaaatcctctctcagtacccactgttctgtccgtggcaaagctctcctgacacatttttagcctttaggctatgtcctatttcccctgtccactagggaagtagttcttgaattcccgcctcccaaggctggcattttaccaagtgaaagacactgcctttgtgcaactccctcccctttgagtgtagggaggaaataggatttccttctgtctcatggaatatgatagaggtaatggaacaccacttccatgattacgttatataagcatataaatgtgtcttcctagcataccctttctgttgcattcttggtttccatgctttgatgaaatgagcaaccatgttgaacaggtgcaaatgtcaagaagctgacagctgcctctgaacaacagcctgcaaggaacagaggcattcagtccagcagtccacaggacattgaactctgcaaacaagcgtgtatgtttggaagtgaatcttcctatgtcagctttaaaatgagaccccagctcaggccaacaccttcatcagtaagagacttcaaagcagtgggtccagctgagctagtgcctagattcccaataagcaaaaactgtgataaagtaaatacattaatttgaagctgtttaagcctactggccccacccagtctcttcccaaccctggagagtacatttcaatctaggtgtctctttccactggatatagacattggttggcatgcagctaaaatcaggccaatatgcatagttgcatattaattaaatttgtggttatttgttagaaagtagtcaataactgtggcataataagcaaaaagtggatttcagctgagtacagtagcttgcacctgtaatctcagctacttgggaggctcaggtgggagaattgcttgaggccaggaggttgaggctgcagtgagctatggtagcgccaatgcaatcatagttcactgaagctatgagcctgggagacaaagcaagaccttctatttaaaaaaatacatggatttcaaaagttggacagattgtaacccaaattctacatagataccatgtctccaatggagggatatatatttttaggttttgcaatcttaggaatagttggcaagtgaaagaaattctggttaaattgacttaagggaaaagaagagattttcagcctccctttactagcagtacatttaatttagaaaatagtgtcctcaggtttaatcattgccgttaggaacctggcactttggtgccatgtttcttcttttggctttctcagagacgctgtctttgtgtggtggtaggcagtcaacagcatttccttgtatgccattgtttcctcagaaagcaaattggcccagtaactgtgcatattggcctaattttagttgcatgccaaccaatgtctatatccaatggaaagagacacttagattgaaatggcctctccagggttgggaagagaccgggtgggtccagtaggcttaagctggatgcaagtaagattgctccccagaggaaaattgaatgctaggtaagcaaaactcattgatgtccattgtcattgctcaaactgcaaatagtcccaaggaagaaagaatggcatgggtgcttcatggacgagactaacttgggggaaaaatcttacctaggatgtttctttttttttagctgaaaagaagcacttggacattcagaaatgagaaaacttgtttattagctgctgttgttggtttgtaaacagctgtagcttttagtgacatatagaaataacatgacaggaacagatgaggatatttctattatgatgttatacaggcagttctatgttgggagtcatcctcctggggcaatcctggatctggaagctgtcagctggtggcaaattagagatagcttgagatttaatgccagatgggaaacatgacctcaaatgaattagggtctttagtcctgggtgtaatatgctgtgcctgacatctcttttaagagttctaactgaaagtttaggtttactgtagaataagccaatttggggagctcatcttgtgaacatgaaaatgaatttggacaaatttcaacctaagcctttagcacagttaaagtttggaaagagtttcattgtagagcgttaggcaattggctgacaaaagagcatccagttttttctcaaggaattctgcaaaaagcaaaggaggtcctactcagccatcctcctttttcagcttagtggacttgtttgtgagattgtgctgtgaatgggttctcaggctggtgataaaacctcatcttcaattcttgtgcagctttgtataagtccaaagaggcaccactatatccttactacatgaagtgtcattgggttgtttgttaatgtttgtttccatatgggccccaggcattagcaaacatgtagtttattcatttatttattcactcagtgaatatttattgaacctaatctaattttcaggccattttgctaaatgacatcctatcacttttattgaaagccatagaggggaaattgcacaactaactggaaccatttagtataatcattgcaattatgcagcaagctggggaggtatgagaacatctgggaggagtatgtatccgagactgagagagtgaaaatgcagtaaggagaaatttgacgaatgagtcactgaccaaattgctgggaggaaggtcatttcaggcaaagagaagagtgtgttcaaagctgaagtctagagcctgacattaatatcgattctcttagctaagttgtttatgaaactgaagtttgtgaatttgaagcctgaaatgtctgaagtgtagtcaatgtatggtcagttaatctcagagcacatccttcagtcatcagtggaactagagataatatattgacatatgtgctctaatgaaagctgagaagctcaaccgggacaagtgtttatctaaaagggggtctgacctccttttagaaatgggaagcaagtgtggacagcataacccatagaccaaatcattcacactttctgtcggtttttaccaaagggtttaatggaacacaaatacacccatttatttacgtagtgtctgtgactgttttcacactacaaaggcaaagttgagttgttgcaagagaccatgtggcctgcaaagtctacaatacatacaatcttaccctttattttaaaaagtgttctgacacctgatgtaaaggactggcttcatgaagtcaagtggagatcttctaagttaccatatagacatgaaaggaagagtacagaagttccatgatgtacagcagtggtttacaaattggctatgaatgttttccaaatgcagattcctgggctctatccaggcttccagtgaatcacaaaatctgaggatagggcccaacaatttgcattgtagtggccttgtaggtgatattgatggcaaaaatttgaaaattggacctgaatttttttttttttttttttttttttttgtgacggagtctcactctgttgtccaggctggaggacagtggcgcaaatttggctcagtgcaagctctgcctcccatgttcacaccattctcctgcttcagcatcctgagtagctgggaactacaggcacccaccacccccggctaattttttatatttttttagtagagacggggtttctccatgttagccaggatggtctcgatctcctgacctcatgatccacccacctcggcctcccaaagtgttggtattacaggtgtgagccaccgcacctggcctgaaatattttttaatccaaatataaacagatactcctttctgccattaataaacaattagggaaaaaaaaagataaaagcctgtttttaagaccattgtccatatggcttacacaagataacttcctgaagtgacctctaagacgaaatagttgcaaagtatttctgtgttcaattaaattaaagcgtgggcaaaaagaaattattagttgtagatatttaaaatcaaatcagtttaaacaaaacactgtcaacacagcagccaaagaacataatcaatcaaaagatgaataaatatacacagttatacagcactactactacataatgatgattatgatggtgatgatgaggatggtgatgaggaggatggtgatgatggtgatgatgatgatggttatgatgatggtgatggtgataatatggttgatgaggatggtaaaagtgttggtgattttgatgatgttggtgtagaggatggtgaagccatgctaatatgttgatgctgatggtgatgatggtgttggtgatgaggatgctgaaggttacggtgatgatgaccagatgacgatggtgctgctgatgacagtgatgatggtgatggtcatgatgatgacagcaatgaagataacaaatactgtgatgattgttttggtgataatagtaataactgtagtgatggcctgtttctacattgcaatctctatttctcccccagtctccatacaaacagaaccaccttagagacatttcaaacttaccatattcaaaatgcagctgctgcttttgatacaatgaatgcccttctgtcgcatttttactatcttaggagaattcacaccatctcctcatcatttaatgagccaaatgtgctagctgctgatccatgtgtctgaatggctgccttgaggaattggggtcctacagtgagcagcaatgctggactagggcaaggatgaataaagaagggatgagttcaagttgttgggggaaaacagggcagccaactctatctggagctctcagatgggcttagtgttggtgaagatatttccaaagacattttgaagacttggaggtatgttatcaggcagaacagagcttctaactaagagcaattttggacctgctgtacaggacagcctccaacccacacaatgatctggcccctaatgtgaacattactgaggtagagataacatgaggtagactatagaagtctatagaaaaagagaatctgagcaaattgtgctaggggaacactgaagaatgtggagcaattgaacaaatgcctgtgcagacatattggtacaaaattgcaatggagcaccaatgggacaggaaaaagggacaagtcctacaatatacagttcttgaccatccctgaagtgcaccaaagctacagaagttggtgtgcgtgaattgtctcattgatcctgtttggtaattaccatgttgactgctggagtcccatgaaggaacatttttaagcagcaaagtgacaagctctgatttgcattttgagattaatgactcagacaaccagttatttgttaacttgctggattcagcctaggaagacatctagagggtgtaatttgatttattttgcagagggatgattggcctctacattatcttggtacactgcctgaatttctgaacaccacagaattatgtatttggcatatggccatctcatttctaagacccatcaaagatgtgagaatggattagatgtggaacaagttgaagattagattagtttatcagatgattagcatgccatgctaatttatcaagacatgggatatttaaagaaggggagagtaacatatgtatgtaacatatagagggaagataggagacctttgtctcaatttcttttttcataatgaatcagtaaacctattggtagataaagtttagttttaattctgctttctaagttaggctgcaaaatattttttatcagtactctctgaaactgactgtcatgtcaagactctaaaagagtatccatagttatatttaaaaataaaatatcatcttttcatcttatgtagaacaacgtctgtttactactgcttggaatacaaagaggaatttagctgtggccattagaaagtgacaaacagtgtttcttccactatgccataattatagtgagaggaaagcatcaaaaagaaagttcttttatatacagttggcacaaaaatattcacatatgtaaataatataaataatgcaccataaaaagaaaaccttccattactattaacaaaattaatcagttgtcattaccatgggatttaggatacatcttacatgttcttggttagattcatgagtcaaagaataatgcccaattgatgaaagtgggctgtaattttgtgcttttaaaacaatggcctctggccaaatatgggcaaaataaacaacatttgatttattactttacactgatttcttgcatcctgctggaaaagagagatgacttacaattataacatatttttcctgcaagattaacatcattgttgccagttttatagaagaagcaggaaagtgggcttgcaatgatttattatgaatgcatgaaacaattaatgctactagcaacagagttttaataggaaaaagttaaagcacacagtattaaaaataaaaggggctgggtgcagtggctcatgcctgtaatcctagcagtttgggaggcccaggcgggcagatcaagaccagcgtgactaaaatggttaaacccatctccactaaaaatacaaaaattagctgggcatggtggtacatgcccgtaatcccagctactcaggaggcttgaggcaggaaaattgcttgaacttgggaggtagaagttgcagtaagccgagatgacaccactgcattttagcctgggcaacagagcaagacttcatctcaataaataaataaacaaataaacaaacagagcaagacttcatctcaagaaataaaaaaataaaataaaagggaaaagttggtatcaaaattgtgtctgatttaggcaaggtttatacctccatggatggctttttcataacaataattgtattgacattgggggcttttccgtgtttcagagattttcatgtggatttccaatatggtaaaatatataatattgttatatgagggagtgatggaaaatcccatcaacgttggcattttttagaaagaaaagaagcttagggaatattttaatgatttggggctaggtctgggggggttcatgcctgtaattccagtgttttgagaggctaaggagggagaatgatttgagctctgcatgtttgagacatcataggcaacatagcaaagcctcatctctacaaaaaacaaaaagtgagctgagtgtgatggcaagcatgtgctggcaatctcacctactaggggaggctgaggtgagagaatcacttgagcccaggaatgccaggcttcagtaaactgtaatcacatcactgcactctggactgagcaacagagcaagaacctgtctcaaaaaaaaaaaaaaaattgatattttctttcccccacagttgtcatatacaatgaaaactgtatatttaagccaaaataggttttgtaaacatttaactattaaaaaagagtcaggcttgcacatagatacatgatattgctttgatttcttcagttttcacctgccctggtatgagacccatgaagtaagcattcttctgggcacagaaattatactcctaaacgtattatttattaatatataatggaaagagaaacatttcaaaaataaagacaaattaagctttaatgaaaagcaatcatacactgatgaatttaaagttttggagcaaatactattgtgtttgatatctattagtctatttaactagtgaaatatgagcaacgcaaaatcaaacatcaatagaaggttccaactaagcttgtttctcatatggtttctctgccagttcagacctcaagagtacctcctgtctacaaagtagactctctgccccacacactgatttccagccttttctgtttcatggggtgacttgctgaccttctatgcatgggtaatagtactctgttgacaggcaagagttgtgtcttccacttgggtcttctaatctgctaaagaaagcaacacacaaaatatagcttacaataattatctgtcaaatttacgtcaatcacaatgtggatggtagatcagtggtttctcttatgtcttgaaaggaagacttcaattttctctgcagccgtggtactttataaattatttcctcttccgtcttttaaaagtcactcttatttaccaccccattagccacggattcagtgaaatgcccacgcatgcagtgttggagtcacacattatttcagaagaccacacagcagtaggtagtattaaataaatgtctgaaatgtgagccaggaatgtgtttttactggactgtcattttcttgcaggctcatttgtataattcactccagtgcatctcagttttatttcctattatgcaaaatagaagataatgataggttagcacattctctgctgatactatttacattcgtgtaaatagatattgctaggggtgtgtgcctcagactatcccatccttcatagggccccatgtttcaattttctaataacccatctaagacacctaggcacacaggggagaatactctgatttaaacagtccaccataagccatacacagtggtgcaccatgtggtcccagctactcaagaggctgaggccaagatcagatgagctcaggagttcaacaccagcctgggcagtatagcaaaagcctatctctaaaaaataaaaataaactcaccactctgagttttacatgttgtaaaaatctcccactggctcccgtctattatgcctggtttagtttgaaacaaaatcattagttttaatgtagcaaaattccatcgacatatttttctttataagagcttctcctaagtagcacctgttagagaaatcctgttctaccccaacatctaaaaaacattttcctgcacatttttctataagcatcagaatttcattgttcatgcagacatttttaatctatgcagagcatatttttatatatggagttaggtagggatctcatttttttttcctgcagtaaggaagcattgcttttgacacatgaaagaaacaaggtattttttcccagtatttgttgtgtcagccagggtcctgataggaaaagatggaatgcaacttgagaaatataataaagatggggacagtatatagggcaccgacacagggtagtggagcccttatgtgaagttgctgatacccactgaggttgaactggacctacctacgagggagggaactggatttcatatacataggccttactcgccttctgtcctccagattacctactagtatcttccttggctgaaaccaagggacagccagaaggcaagagtgaactcacttatttaccttccacagtacagaatagtggagatgagaaagagtaaatctggaaggggccagatcccgccccaccccccacaaaaatacaagttttaaaattaatcatatatacatcagccaatcctagggctttatatttggccctgttcatttgctgatctgtttctgcaagatgaagaatgactcaaatattacaaatgacatatgttttccatcttcaacattccccttgcttttggtagaatttattctttcatgtacattatggaatcgatgtgtcaaagtgtgcaacattcttctgtctttgctgggaattgtatttatttaaaagttggtttgaggaaaaataaacatcttctaagcttatgttatctcacttgtaaactggcatagtttattacttgttgagatctgatcatagctttattaaatactttaagcattatgtattaattaattattattagtagtattttgcaattgataccttcaattacattttgtactcctggtataaaataatgttgtttttttacattgatgaaatgttcaaccatccttttggattttctattatttgtagcagcttttctgttaaattacataatttccacaaaaatggtgacattatctgcaaataatgaccattttctctctttccttttaatacttgtaaattttaaatcctttctaacttctaccattgtatgacccattgacatctggtgtgaggatgaatgctattggtacaaaattttattcccattcatgattttacaggaaatgggtctaacatcttttttgtaaatacaatgtcaaggagagatttttgacatacagtcattttcaaataatatgaatttcttgtaattaccatttattttctaagtttttaaaatgctttcttttgatcatacatattgattattgccaaataagcagttggcatttctacagccgcttatacagctgcttatatcataaaagaattataattattcttcataattagtgtgcttttataattaatagatttataaggtatctattcaatttagaaaaaacaaatttttcatcataataggaacaaaatggcctctcgtgttatagtggaatatattgtatattctaaaaatagccactattctactaagtttagtttgtaaatattcacttaggatgtctacatctacattcataagtgaatttgatttataattttatgatgttaaacactctatacttttgatatgaatgttaaactatccatacaaaaggattttgatagctttatttaattttatattttctgcagaaaacttcaatacataggattattaaaaattttctgaaaattatcttgggtgacaagtttttgtgtgggagatttttagttaccctttcaatactactaatagtttttagtttaagtttatttcttcgtgtaatgttgcttttttcttgacgatttcaatttagctttttaatatcaggttttatactgttaaaatattattttgtattttttatattttgatttacttggtgttttaaaagtgattttcctcttttcctttaaagactatttgttttcttaatttgtctcccttccttggtcagtcttggcagaagtttgtttatattataaagcttttcaataaactagttttcattttggtaattatatcaactcttttttctctatttcactaatttctgctcctatcttgattatatcctattttcagatttatttgtatttattctgttttctcttcttcctgccctcttcttgacttgtctccatggcttctttatttccaattattcttgttgccttgtaaaggtatttgaagttttaattgtccctttaagcacatcttcaatctcatctgacaaattttcacatgtgacatttgaatgatccttggtttccaactatttttgtttatattgtatcataaaagcatgtgcacacacccacacacaaacaaatacatatatgcaaactaatgacagaatactaaacatatatatgtttatatgtgtgtaaacatagatatgtgtatatatatatatgtttagtgttctgtgtccatagctttcaagcacacaccaaatgtttacaaaatctacctttcaaaaagatacagcagcatacagcattgtattctatgaccataattcaatagaattagaaatcaatagtaaaaagcgttcaaaataatgatagaacactaaacatatatgtacatttacatgtacatacatgtttacgtgtgtgtgtgtgtatatatatatatctgtgttctgtgtgtgtgtgagagtgtgtgatttgaggtgcatatatttccatagatagccaccggatcacacatgtcagttatttcagtcttctatatcttatttatttttggggtggcaggtgggggactctgtctcactctctcgctggaatgcagtcactcagtctcggctaactgcaatctctgcctcctgggttcaagttattctcatgcctcagccttccaagtagctaggattacaggtgcacaccaccatacctggctaaactttttttattattatttttgagacagagtcttgctctgttgcccaggctggagtgcaatggcgcgatctcagatcactacaacctctaccttccggattcaagtcattatccttcctcagcctcccagatagctaggacaacaggcgcccgccaccgtgcctggctaatttttgtatttttagtagaggtggggtttcaccacgttggccagcctggtcttgaactccttacctcaggtgatcttcccatctcatcctcccaaagtgctgggattacaggcatgagccactgtgcccagccaacttttgtatttttagtagagacggtttcactgtgttggccaggctggcctgaactcctgacctcaagggatccacctgccttgtcctcccaaagtgctggaattataggtatgagtcacgatttgtggcctgtatcttcaattagattttgtcttataagttcatcacaccaagaatgttgagttttattctcttgtaacatttcatcttatcgttcctttgtctggtatatttaatgcatatggatatactatgttatatatatagtatgtatgtataaacatgtacttaccttttacatgttttcaagcttattaggaagttatatgaaagtgtcagttgtacctttttaatcttccattccttttctactatttattatctattattgatatttatgattttggtttgatactaaatttgcttactatgattttttctttacatatttcttacatttaaaatttttagtctcttcctgttcgtgtatctgtttgttttaaatatatctgttttcaacaatatgttgctaaatgtattttaatcacattttatctgtttatcctaattatatttctgcagttatcattattatagatttcatttctgccactttgttttatattttatatgtatcaatcatgctttttaaactttaactttttttttttcctgacttccagtgtataattttaaaagtttctcttactgacctcattattatactccttttttgctgacctcattattatactctttttttatgattttttttcctccttatagtttggattcatcaaatttcctgttttatgttgcacttatattctaatgaagatacatcgattcttcttattggctatcaaacttttcagtatccacaattttcctcagaataagctatagatttaagattttctcaactctttggcatctctctctctcaatcaccccacactgtgttagattctaagggaatttgggctgtagatcatgttaaaatttgattttagaatattgtgtctttggagtaatgtcttgtcattacttgtattatactgctgtattctgggtttatttctctccttccttgcagaaatacgttgtttcaagatttctaagaattaaatagatttggatttaagctatcatttaaataatagtttggctggacataaaacctaggcagatcttttttcccctgcacttgctggggatgagaagccactgctttttgtatcctacactgctttgttgttaccccgattttcaatccattgcacatcacctgctttttctcattggaagaattagacttactttgtttatatttgagatactcaaaaatcagaatttagttttgcttttttctgttttaaatcaacctgttccttactttatgagaactttccattttaagcctttttttttttttttttccctctcatcctgggaacttctcagcctttctgcctaatgtagttcttgctaacctttttctctttgttctctttctgggtcttttttttataggactggcaacacttctacttccatcttccatacttcagcatttggaggatgtttttcctccatttttcatcccggatccattttgggaaagtgtctctctgtcttttgccaccaatatgcattgtttgtaggtatctttccatttcagcctgttctttgtgctctccacttcaacaatttcatttctcctccccagtttctcatgtgacttcctttgacaccctttgttccaactttatatctctataattgtctctctgtccattggacggatatttaatctacttattttgagtcccatgttgtttgcttgggtcatttgatagttgttgttatttcatatatgatgttacatttgtttaagtgttttgctttttgactggctctgaagtatttcttgggagttttttgttgtcgttgaggacagtagatatcttggaagataatgagtatccaatggccagtcaaaagcccaccctcagctgggcatggtggctcatgcctgtaatcctggtactttgggaggctgaggcgggcagatcacccgaggtcaagagtttgaggccagcctgatcaacatatcattaaattagagctttaagttatatcactgatttcatatgccagggaaaattgtaggatgtggcttacaaggcaatctcacaagaagtatgacttttgtcttataaacaacaacccaaccttggagtttgttccagtaaatttcataaatataaaataaactatataaataaagtaactaatatcctactaagtcttttccctcacacatgctttttttgcctaaagccatttaaagtctctgaggatttaaatctataattctgtcatggagtggtagaaacccagagaatatacaaacgttgaaaaactttaagagtcactggtttaacagaagttggctgggcttactggctcacgcttctaaacccagcactttgagatgcgtagctgggcagattacttgagggcaagagtttgataccagcctggccaacatgatgaaacctgtctctactaaaaatacaaaaattagctcggtgtgggggtgcaggcctgtagtcctagctactttggaggttgaggcaggagaattgcttgaatctaggggtctgagtttgcagtgccccgagatcacagcaatgcacttccagcctggtgcaacagagtgagactccatcacaaaaaaaacaaaaaacaaaatgacaacaacaacaaaaaaaaaaaaaacagtaaaacagaaatagatctaatttttcagactagagtcactcagatatggatggataagtccatccactatttgtgtattaagctttttttttttttttttgaaacaagtgtattcacacttggattgactgttaatattcactccaaactaggacattgcaaagaacccttaggatgttataattctaggcatttttatagtctcagaatttcagatgtattgcaatgttgtaattttttatagtttcttgtctttctgtaacacctagtaagttcaaaaactcgaactataggttttcttgataaataccagcgtcactgctttctatgtttatatttttcttttaatacatgaactgagttaaaaattaaatatacatatgtaaattattcttttgaaaaaatattacttataatagtttttaaaatacatgtttatttaattttagatttctgctaaatttgtgaagattgtggaaaggattttccttataccccacccttgaatttcccttctataaatatcttaaacatcattattatacatttgacactattaatgagccaatatgtacaatttttttttgactaaagcccactcattcttcagatttctttggtattttcattctgtctttttcctttcctcaaaccccaccccagatcccacattacatttagcggtcatgtctccttgggctcctcttgattgtgatgatttctccttctcattttgtctttcatggccttaagagcttaaggaggactaatcaggggattggtagactgtccttttgtttgggtttgtctgatgttcttctcatggttattctggggctatggattgtgcagaggaagaccagaggtgaagtgccactttccttactttgtatcaagggcacatactagcaccatgacattgcagttgatactgaccttgatcccatggatgaggtgatgttggccagatttccctactatcaagttactcctcttgcacacacactttccatattgtactctgtgaaaagatgtcactttgtgcagcccacgcttaagaaatggggacctgctattccccccggagggcagagtatctacagaaattacttgaaattattttacataagagatgtctctattctgagccactcatttactccctcatttacatatatcagtatggtcttatggatatttattttatacttcaggttgaaatctaatatgatgttgtttatctgcatagattttgtgtttgtttttagtagatatgaggtctcactgctttgcccagggtgttcttgaactcctggccttaaactttaaaactttaaaaaagagggatagctttttaaaaatcctcatttttactttagatccaagtgttaaatatgcagatatgttacaagggtatattgtgtaatgctgaggtttgggcttctgttaggttattctgtgtccaaataataagcacaggaagttttttagtccttgtcccccctcagtaacagcttgtaggaaataatttgagactgatcatttttaatttttaagcgctgaacatgcagttattttatctggaaggtagactagaaaaacaaaattatatttgacattttaggacataagtgttttctcattaatcttgatgtacacaaagccagattatcaatgtatttgttcataactctagcttgtttcattaaaattattttcctgcaaagaaaacgcctttttgctaccctgaatatttaacaatttttagaatattttatctttaagagctataaacatgttttaatatcccaaggtaagatatggagatttttgtagtctgtccagcctgctgtagcagaataccttagactgggtaatttataaacaatagacatttattattattattttcattgagacagggtctctctctgttgcccagactagagtgcagtggcttgatcatggctcactgcagtcttgactttgtgggctcaagtgatcctcccaccttagcttcccaagtagctgggaccataagtgtgtgccagcacacatggctaaattttatttttatttaacttttagtaaatatgaggtctcactactttgcccagggtgttcttgaactcctggccttaaacagttctcctgccatgacctcccaaaatgttgggattacaggtatgagccacttaacccagttaaaaaccgacatttatttcacacagtcctaggaagtccaaagatcaaggtgttagctgattctttgtctggcgagggcccattaccccacatggcaccttcttggtttgtcctcaaatgatggaagggaaaaagcagcttcctgcaatctcttttatatggacactaatcctattcatgagagtggacttatcacaatgtatattggatttcagcatatgaattttgggaggttaccaccgttcagacaatagcaagatacattaggtgtggggtgttctggacttgagtgaatctgtgtaagtccttcacatgtgctttgctttactgcttggggtagctatttctgcctcaaaccacctcagagggcttcagatttcagtgacacacctgtcacttttaacgcacatccttgaacctccgtctgtgtgcagattaagcaacaggtgattttaaggttcaggcctaaggtttttttattattgcctttcatttccatttctagttcttccaaaatccttcaaaatgacacctgagaggagacactcataaacttgttagccaggattccaaggtacatagaagctgtttctcctgggtgaatattacaaatgcctccaagggcaattgaatttctttctgtctttcatggatttttacttattgtccagatatgctcctcctagtgagagggtcacttctgatttttcctgcctccacagaacaagggcttcagagaggagacactctacagctcctttgttattaaattattaaatgcatttctagtatgaaggcagcctattagaaaaatccagtctgctgcatatctgtttatagggtttgagcccagtcaagtgaggatgcacagaattccaccattctgacagcccagcccccttgcaattggaagggtctccaaattccttccttgcagctagggttactggctatgagtgacagcctcttgtgcatagggagtgagggcggagagggaccagcagagccctggaatgtcctttccactggacattgagcatctagacagctcagactctggaatagcttgtactataggtgcatgctaccatgtatggctaatttttattttgatttttgtagacatagggtgtcagtattttgcccagattggtctcaaaaatcctaacgtcaagcgatcttcctgccttggccttccaaagcactgggattacaagtgtgaaccactgtgcttggccataacctatagtttttgttagagattattaaataaggatgagattaaaatgaggttagtctcatgctgcttaaaacagtgatatgcttaggagcagctgcaggaacatctgatccaatcttggaggcagcctgaagggcttcccagggaaagcacaatttaagccaaaacctgagagatgagcagggattgaccaactaatgagcagacccacacaccaaattctgcagtcagttccttgcatgacatggaaaattgatttctacaactatgcattacttttctcccaccaatcccccgccctgctttattttttatctttatttctactgggtctctgtcactcaggctgtagtgcagtagagtgatcttggctcactgcagcctcgatctccttggctcaagtaatccttccacctaagcctccctagttagaatagctgagactgcctacgcacaacaccatgtcggtccatttttttttttttttttctttttgtagagatgggattttgccatgttggccaggctggtcttgaaatccttggctcaagtgatcagcccaccttggggttacaggcaggagacaccatttttattttgcatgtgtgcggtcagtcattctacaactaataatatttaataataattgaaaatatcctgtaaattccaaaaaggtaagcttaagttctcttgaaaaatgaatttctgtgagaaggctttggtggtttgacttgaagctgataacaacattagtgttgggcatttggctacacacctgtcacattcaaaatccaatctattttcaatctttatttcggtggcagtaagtgctgaagattttaatccactatgtattttcctaacccagattctactcaaagcagaggtttagagaaatcccttgtttattgcaaatatcatgccaagaataaggatgaggaaccagcacagtgatgaagggagaaatgtaatcactatttacaatagccaagttgtggagtcaacctatgtatccatcaaccatgcattggataaagaaaatgtggtacatatacaccaaagaatactaggcagccataaaaaagaatggaatcatgtcctttgcagcaacgtgcatgtggctggaggccattatcctaagtgaaataactgagaaacataaaatcaaatatcacatgttctcacttataactaggagctaaacaatgggtacgcgtggttgtaaagatggaaacaaccaacaatggagactcaaacaggggaaaggatgggagggggtgaggtttgaaaaatcacctatgggtacagtgtttactcttgtgtgattggtaccctagaagcccatatgtaaccagtgtacaatatacccgtgtaagaaacctgtacatgcacccctgaacctaaactaaaattaaaaaacaaacaaaaaccacacaaaaaaattgtattggccacagaggagagatgcctgcttgacccagtgaggttgtgtgaaaacccttatgatatatgtccccataccactttcccaggtgaaaatggaggacccacattctcctcatctttcacccttaataatgtactggtgttgacatctccaggctacttggggagtgctaagtaggttttagtgtgcatcccctgtaaggcattgaagaaaattcaggaaatcaagaaaaagtcaagtttccaggtatgaagagaggctgcaccttcatgaagctggttgaagtctggacagagcagatcaccacaagagtgactggaataagccatgtggccaagaggcatccagtgcagccatcaagtgaaacagagctcttccagccgtggtagaactagggtcaaactatgtgaaagtgttcaaagattctttgcattgaattcaagctcatcattcacttgcgctcaaatctgtgagaccatgtttatattgtaaagaaaggataaaacataaattcatatttcaatttttaggttatctgaatgaatggatttcaagagtgcttaagttttttcctagatgttcacagcttttcaaatcatcttcctcagaacactgaatcctgctaattgagtgattttctgattgtcatgtactcacacaattgactaaatgtcttactatgctttcttgataagtagtgtctacatgtgaagaacctatctatttaatctatctacctgcctatatatctctatttctccatctagtctatcaatctatcttatctatataatctctatgtatcatctatctgttatctatctatctatctatctatgtctatcttctctctttctctctcctctctctgagttgagcaaattacttacaagtttttgtcatgtaagtgagcaagactatatacacacacatataagaaggcttgaactacaacattaaagtggctgcagattcagtgtctggtggggacccacttcgttgtccatagacagggccttctcactgtgtcctcacatggtagaaggggcaaaggagggggctctctggggtcccttttataaaagcactcatctcattcatgaagctccatagttatgatcttatcacctccaaaagtgctcgcctcctaatagtgtcccctcggggattaagatttatatcttttgttttaaatttttaatttctatatgagtacatagtaggtgtatatatttatggggtacctgagatattctggtgcagacatgcaatgcgtaatgatcgtatcacagcaaatggggttgtctatctcctcaaggacttgtcttttttgttacaaaaaatccaattgtattatttcagttaaaatgtacaatcagtttactattgactaaagtcaccctgtcatgccagcaaatactaggtcttatttattctttctgactataatttttgtacccattaaccatccctactttccccatcctactcccactatcgtttccaatgtctgataaccatcttttgattctctatatttatgaattcaattgtttcaatttttagctcccacaaataagtgagaacatggtataacggtctttctgtgcctcgcttatttctcttaacataataaccaccagttttatccatgttgttgtaaatgacaggatctaattctttgctatggcttaatagtactctattgtgtatgtgtagcccattttctttatccattcacccgttgatggatggttaggttacatccaaatcttggctattgtgaacagaattgcaacaaacatgggggtgcagatatctctttgatatactgatttcctttctttgggggtttggatgtaaacatatgagttttgagaggacaacattcagactgtagcttactgtactatctatccattcatccacctgtttatctattccatttctaaatattgcatggcatattttcttaattctttccaatgtcttattgagttttaatataagtttacgtttctgataggccacatatgggggcatcctgaaaagtacatctgaggcaggtcaggagtttgagacgagcttgactaacatggtgaaacctcgtctccactaaaaatacaaaaattagccaggtgtagtgggggttgcctgtaatcccagctactcaagaagctgaagcaggagaatcacttgaacccgggaggcagaggttgcaatgagctgtgattgtgtcattgtactccagcctagggtgcagagtgagactatgtctcaaaaaaaaagtacattatctttatattttaaatgttttggggttttttctttatttttttcatatttaattacatttctttcaaatgacttctttgggagacatgatttttgtacctcctgggactgccacaattctcctgcctcctgggatgtgatcgatctctagtctgcctcaagtataaagatgatattcatgttgatgacattgagaaggatgaggagaaaggagttgatcagagatctatattcatggtatacttgtttgccatgtctgcttttcctcttcagaatgtaaactccaagactgtgggtctttgttttcttcggtactaccttgcagagtctaggtcctattcaaagcttaatatttgtgaagtgcatgaatgaataagtggattataatattatcaccaccattggtatggcttttgtttctctatctgtattgtcctctctacttttccttaattgtttaattcccacacagattgccgaagattgctttgccaactgtccctgggtagagataaatttccctccatggtgctttcactggactctacctgcagctatatattatcttgcattttctaacacccagccccaccacataataagacttgattgattgaagaccctgagttagctttgcataaaaccaaggtgctttccacacagacattcacagacattttcacatttcatacagcaactgatgaactaggctggaaatacactttttactggcttaacagagaagaaaacaaagcttagggagactgattatgcaggatttaatttgtaacaagcaaagagaacactattgacttcaagtggacatcaacacattatcatctgataatttttccagcatcctttgcctcatctgttaaattataaactaatgctgatgtgtacaattcagttcagcttcacaaatatttaatgaacactcgctctataacaggtattattatataaatagttctttatgatgtaagaatgtttaatagatactttttatccattcaactttgaaaggctaatgcctattcatagataccaggaaacacttgaatgaatgaagacatgttttctgctgtcaaagagagatcagacaccaacaagtggccaagaaagaacaaagtaattttgatcaacaaaacttatagaagaaaataagcattctttgttgttacatatacttcagagccattttagtgctcaaagtttgatagaaattgatacacaggacttgcgcctctgaattggctatcccggaatattctatgagctacaaccagatttaacattaacctgtagttacttgtggtttattcatctatccacctaaacactatgagcaacttcaatgtgctcttcatggtactcgactttaggcattgtatatggagcaaaatagacatattttcttatttattgtggcttatactcagatgcagcatttcttcaccagtggtaattttgctcctggggacatttggcaatgtgtggagacagtgaaggttgtcatgactgggtcttgcttctggtgtctaatgggtagaggccagaactccttcacaataaagaactatctgaccaaagaatatcagcagtgccaaggttgagaaactcttctaacggttggagaaaaatgatcaatggatcacctacaattataattacaaactgagctatgtgttagatgctagtagagctgatttccaaggttactgatctagtcatgaggatacatattgatactaaggacatgtggttgaaggggcaggagtgatttattagggtaagaagttcatggtgagcagagggactgtcatgcaaagactctagggcttgaaggagcccagtgcaatcaggatctgaagtgacaggtgtggcttgagaacagaggcaacagggagttaggcagaaggggaagctggaaatgcaggcaggggtagaaaataaaaatatgccagccatttatattacacaattctgtagacttctttcttctttcattcttgatacttttctataataacattcaagcattggatcagcaccctttgttgtcttctgtagcccaaaggttgaccttggagacacaaaggcaactatgacaatggtttctgcaatagggagatcacattctcactcagaagacatttgcagggtgtgattagtgattctcacatacatgtcaatttcttcctaagaccttgtgcttttttagtttttattttaatattattattgttatttatatagtttatttgagagaattttgctctgtcacacagactggagaccagtgttgtgatcatagctcattgcagcctccaactccttgtgtcaagcaatcctcttgcctcagcctcccaaatagctgggactacaagcatccaccaccacatccagcttattgttttattttttgtagagaaggccacctctacaacttatgttgcccagactggtgtcaaatgcctgggctcaagcattccttctgcctgagtctaccaaagtgctgggattctagatgtgagccatgaaaccctaccttctggtttttaattggcttattttcttcgcacatttcagtgaagcattattcatttatcgttactgaggttttacttttttttttctttcccagagttagatttcagacaactcacctttgttaccaatttgaaatgctaggtgtcaattcttaatatagttgtaaagggccatgacttgaggatatgttatttttttgggcttgagtttggattggtttgagttgaatgcaattgctaagccattgaataagggaacattgctgaactagagtgacatggattatttcttataggtgagagtgcatttgtgataaagtcattgttttaggatacataagggtcatggtgtattttcttggctagtgctatgaattcatttgtgctatttcttttgaatttttgtatttctctactctccatcttattaaaccaggtgtttcaggtttgaggttctgcacatttttctctggggttacacagagggactaaataggtggagtttagggtaaggggatattcacagtcctgccctcctgcaaccacagcaacaccccaaagtctctcataagactgtatttgttctcctacttacattctttgaccactattatgaacgttttcaatagtctatccaatgaaaacaatgttgtcaatgactgtctttagtaagtctgtagtcagattcatatctttaaaatatgtacactgtgtgaatatttcaaagtatatatcatgaaaataaataagaaaaaaaaaacaagaaagctgagatagctctattaatattagacaaagataccttcaagaaaaggagtatttccataataaaagagagatagtcataatgatacaaggaagaatccacctgacataactaataattttaatttgtgtacacctaataagagagctgtaaattacacaattagacagcaataaatgcaaagaaagacccatcaataatgatagttggagatgttaagatgttaccaaaatagatgaaagatgaagttggaaaacacacacacacacacacccccacacacacagatacatacacacataaatacagggaggatacacacacacacatacatgcagggaggatatgaaaattttcaacaacactttcaatgcccttggcaagtttgtactttgagtccaacctcccttcacaattcaacaaagagacaaacaacccacaattttactgcatttcatgcttaggttcccggtgtctcaaggcctctggccagccatgtgtgtacaggaacacacacacatcaaataaacagaaaaatgaatgtataatcgcagactgtgattaacaccatagatgaaaatcagagagggtgtgcagtcattaacaggcaagctgacctcacctttgatacaaagacacaatggtgttcaggcgaaaagcaatgaataggtgttacccagttggggagataagaatggtgttgtaagagtaaggtaaatttgtgcataggattccagttggcacagattttttagtgcagaaacaggaagtggaagagggacagggttgaggatgtataattcaacagatcattcaggtccctgttggagaactttaagcagggctctgtcaaagtcagtttggtcattttgatagatgactctgggtggggagtgatggcagaatgagatggacacatattaggcagtcactttcatctagcagagacactgacagcctggaccataatgacgaagatggagaaaagttatatgaacctatttgagagatatttcagaaggaaaccaaagatgtgatactgagttacctggaatgtgggaaaggaatggaaagttggatgacctttccatctagtttctgtgtagattctgtgcatgatcccttggcttaagacataagcactgtgagattacagataatctatgtataggttcatgtaaagagttttcccttttcttagatttccatctaaattgagattattgtctttcactgcatgtaatctcattactacctgatttggaatgctatttccttatacaagcatgttgtgagaataatgcttggtgccaaatgttacgcaaatagtattgatttaaatgtggtaacatagataactgttaacatatgtacaatagataacacaagtatataacatataaatatcatataataaatgctaattaatataaatgaaatatactggggaggaaaatctgaaaggtgttaatgacttagggaccttatcaatatatatcaatcattctcacactgttatgaagaactacctaagcctgggtaatttatgaagaaaagaggcttaattgacatgcagttcttcatgctgtataggaagcatggctgggaggcctcaggaaacttacagtaatgattaaaggtgaaggggtaataagcacatcttaccatggcagagcaggagagagaccgagccaagggggaagtgctacacacttttaaacaaccagattttgtaagaactcatgaccaccggaacagccaagaggaaatccacccctattatccggacacctgccaccaggtcattcccccaacattgggagctacaattcgatatgagatttgtgtggtgatatacagccaaatgacaacataacctctcataatgctatttccttcatgataaatatcctttgaggacaaaatgtcattcaaaatgtgataataatgttgataataattaatgcaagcctaataaacattctctgtatacattttgtaatacattataatatgaattatattcagtaataatttcacttaaagaataatttaaaatataacaggcagataactataggtaatagtttaaaacataacactaaaacttgcatggttttggtatttcaaattttacgtggattctactatattttcaaggacacaacgaacataactgaaggcaaaccttgaaattttactttcttaaatctgattactttcttaaattttactttcttaaatgtgatgagttgtgttaatttatttggaataattaaactcggcattatatattcttttttatgatgtcattaataatgtttaaaagtcaataacacatctattgctactttggttaaaagctacatagatagtagtagctatggtacttggatgaagaaagctgaagtttattattttttctttctaattttaatccctaagggtctttgataaaagacttacacaaacccccctttagtaacctaatcttgtaaaataatcctgttcttaaaatggtgatagagatttgcttggtttatgctacgtaacaccataataacacattaagacttgattctctttatatcatggagcaactcaggtagtgttacaaagtgctgttactcaataaatgtggtgaagagcaagctctccagagcagtgccatgcctgtgtctgatgctttccagtatggaaaactgctcagatactaatggtttgtttcaggcgcattgacagcctgatcataggctctagccatgtaccatgaaaaatggcttctccaggggcttaagaaagacgatgaagagctttgcattttctcttggcatttcctgctattgttaaaaaggtcacatatgcaatttaaaaatgttccatgcatggagcatgacaaatgccatgtagaagataaaactgctttcattgacatttttggccaatttccaaacggtaccattttccacattttcccctttgtggatttgcaaaatttggcttgtgcaaaatgcctgcccacaatacagtctaagttgagaaatgctacatgttaaaaagcaaactgtgtatagatgaaaatggcacattcagaataaaagtaagaaattaaatgccaccaaaaaatagggaaaaacttgtaaatgagtctatcaaaactattaaggaatctcaaaatgaaagaaaggcttagaactcatcaataacaatgtccaattgcattcatatgtaaagaaagtaaaatcaactttatgttattttagttcactttattttattcttattatccttttacctagttgaatggcaaaactaaatttagttatctttgggcattgaaaaatgagtactctcacagtttgatagatggaggaagaattaaggtagagttttagaatttgagtattatacaataaaatttaaaaagagacccactttactcctctggaagcacttttgcttccaggaacctatcccacagatatatgcagaaagatgtatgtacatagatgatcattgcaactgaaatttatctcatcaggaaaacgtgtaaatgaatttttttgagcacttagaatactaaaactatctttcccttgaaattgtagaggcaaagcaaaatgggaaggcagagaataatacataaatttatgtaagcatgtatacatactggtatatacacatagatatgaatgcacaattgtatgcatagacatatgtatacatacatgtgtgtgtaggtgtatgcttttgtgtagatttgtatacaaatatgtatattttactgcacagaaaaatgtcaagaaataaattattagcaatgtttagaatgggactatgttactgtgcccttacagagaggccttgattggcagagaaaatgaaaactataactgctcctatacttaagaatttttaaaatcctttgtaatgagtttgaataatttatttatattacaattatgcaaatcttctatgtgtgtataagaagccattagaaaaagatggtttcatgtgatagaggaaactagcataagttagaattttgactcagctgatgagaaagtatttgcccaaagcaatctaatcaaagctctgttgcatgagcctggtgtggtgagtcacacctgtgactgctttgtttgggagaccaaggagtgaggatcacgtgagaccaagagttcaagaccaggctggtcaacatagtgagatcctttctctacaaaaagtttaaaaaattagctggccatggtagctcatgccttgggtctcagctatgcagaacgctgaggtgggagtattgcttgagtccaggagtttgagggtgcagtgagctatgatcaaaccactgcactccagcctgggcaacagaacaagaccccatcctttaaaaaaaaaaaaagaaaaagaagaaagaaaaacgctgggcatggtgggtcacacctataatcccagcacattgagaggccaaggtgcgtggatcacttgaggttgggagtttgagaccaatctgaccaacatggagaaaccccatctctactaaaaatacaaaattagccaggtatggtggccggtgcctgtaatcccggctacacaggaggctgaggcaggagaatctcttgaacccagaaggtggaggttgcagtgagccaagattgtgccattgcactccagcctgggtaacaacagtgaaactccatctcaaaaaaaaataaaaataaaaataaaataaaaattaaacactttgttgtgtggaaaaaagacatatagttaaacaaatataaccagccccttatttctgaggagaaagactgatgcattgtagaaaggataatacaattttgagatttaggtaaggactatcagaatttccaggaagctctgctgtggttcattgttacagggaaattactcaagggaatatatgacttggaatcattttgcttttttgttacatttcctattattcattgcttctttggactggtgagaagcctctcagagaaataaggaatactgcacatcctccatattttctcagcttttgaaaattaagttttatacacttaagggcagccacaacacatgaaaacattttatgctgggcgcggtggctcatgcctgtaatcccagcactttgggaggccgaggtgggaggattacgagatcaggagataaagaccattctggctaacatggagaaaccctgtctctactaaaaatacaaaaaaattagccaggcgtggtggcgggcacctgtagtcccagctactctggaggctgatgcaggagaatggcatgaacccaggagggggagcttgaagtgagcagagattgtgccactgcacgccagcctgggtgacagagcgagacacagtctcaaaaaaaaaaaaaaaaaagaaaagaaaaaaaaaagctcatgggtaggaagaatcaataacatgaaaatggccatactgcccaaggtaatttacagattcaatgccatccccataaagctaccaatgactttcttcacagaattggaaaaagctactttaaagttcatatggaaccaaaaaagagcccgcatcgccaaggcaatcctaagacaaaagaacaaagctggaggcatcacactacctgacttcaaactatactacaaggctacagtaaccaaaacagaatggtactggtaccaaaacagagatatagatcaatggaacaacagagcccttagaaataatgccgcatatctacaactatctgatctttgacaaacctgagaaaaataagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcgtgggcaaggacttcctgtccaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaacccatcaaaaagtgggtgaaggacatgaacagacacttctccaaagaagatatttatgcagccaaaaaacacatgaaaaaatgctcatcatcactggccatcagagaaatgcaaatcaaaaccacaatgagataccatctcacaccagttagaatggcagtcattaaaacgtcaggaaataacaggtgctggagaggatgtggagaaataggaacacttttacactgctggtgggactgtaaactagttcaaccattgtggaagtcagtgtggctattcctcagggatctagaactagaaataccatttgacccagccatcccattactgggtatatactcaaaggattataaatcatgctgctataaagacacatgcacacgtatgtttattgcggcattattcacaatagcaaagacttggaaccaacccagatgtccaacaatggtagactggattaagaaaatgtgtcacatatacaccatggaatactatgcagccataaaaaatgatgagttcatgtcctttgtagggacatggatgaaattggaaatcatcattctcagtaaactatcacaagaacaaaaaaccaaacaccgcatatgcatattctcactcataggtgggaattgaacaatgagatcacatggacacaggaaggggaatatcacactctggggactgtggtggggtggggggagaggggagggatagcattgggagatatacctaatgctagatgaggagttagtgggtgcagcgcaccagcatggcacatgaatacatatgtaactaacctgcacaatgtgcacatgtaccctaaaacttaaactataataaaaaaaaatggcataaacctttaaagccacaaaataaaataaaataaaataaaataataaattccctcaaaaaaaaaaaaagaaaagtttatttcttcctcaaaccttctttacctagcctcactcaaaccaactcttaatttttccttttttttttttttttttttttccccaaagctatgcagctgacacgcatctgctcacttggcataattcagttggcatccagtaagtttaagaaattctatctgggattcatgcaatcacaacccacatccaaaaaataatagcagcacttataataaataataatagtgttttttgtttgtttgtttttttagtattcacataggttttctccctggattttcacaacattgaaacaaaatagacaaaataaatgggcttctcttcagccctgagttttgcctactcttaaccctttggagaaaaaatggcactgagctgtcagtcagtcgccctgtgggagaagacaccagtgtagatggctttctgaatatattgacttgatttctatcaccaacaatggcatattcaggctgtgctccatgccaggtgccatgtggtcatggagtctaccacaccagaggtattctcagaagtagtattgaaaacacataggcaagcattgcttaagactgtataaacataagctctgtccagacatggaatacagtcggagtttgctaggataatcccaaataccaatacataccagaaaacttactatagcatgagtattgaaggcaaagatgcttttggtatgtaactaaaataatagcatgaacccatcttttagtgtgaatattgaataattaatgttacatacatgaagctagcatgtactggaaggactcaaagtaactgaaaactatacatttcttcacgccatttatttaagacttcagctcctttacacaaccatactcagttaccttttgcctgttcctgacttactaagggaagatggtgtggagctacaatttataatccagataatgattactagagtccatactctaccctgaatactgaaaactgcaataatgtccctaacttaaacttcctcttctgtttatcacttcttccttccctctttgattgttcttccatgaatccttgcaagtctccaagcactgagtatccttccatccaccaaatgtctgatatagatggctgggtgtaactttaagtctctcactaagatgatcgattttctcctctgcttgtgctgggctcaccctctcatttctcagccaagatatcgatttattgtgtcccatagcactgctagcattaatggaattattgcatggtttggcctcatttttagtgtgtggtttttagaaatatctgagatcttagtgttggtttgcaatctgtcttagtcccttctgtgctgctatgaaagaatacctgaaactggtttataaaacagaaatttatttctcatagttccagaggctggcaagtccaagatcaaggcaccatcatctggcaagaccttcttgcacatcatcaaatggcacaggggtaaagagctgaagagagagaacccactcctgcaagccctttttgataatgatattcatctattcatgaatttaattaaattcaaactattcatgttcattacctaaacatctcccattacccactaacccacaaaacactgtcttattaggggttaataatattcatgacaatgcatgaattctagggacacattcacaccatagcaaaatccatttacactctctcctcatcaaggtttatgtgttttccaaagtgagtcagttcaagtttttttgacctttcctcttttgttttcattagatctcatttttagactaacagattactttgttcctataactcatgtgtctttcagaatctgggccagtttccactacccaagtgggatctaggagttaaccccaccgtcaacccaagtactcctcctgtgtccaatggccagtcagcctcaatcctgtcttctcttgagttatgacatatttttcaccttccattaatagtgagtctgttgaaataggaatttatacttccttctttgtcctccatttccccaaaatccgttctctatccttacaattttatgctaataaatctcattaaggtatgaccagtgatttctacattgccaaacccagtggcgtctttttagtgatgatcctatatcaatatgataggcacttatcacttgcagaattcttattccttttcattgtatcactatgctctggttttattctacaactctgagaagttcttttgtattttcttctcttactattcttaaatgttgacttttctcaaggtttgttcttgacttcattctgtatattgtatgtctgggtaattcattgcatcttcttatcttccaactatctgcctctatgtggatgattcttgagtctttattttcagcccaggccactagcttcattcagttacagtgtttgtaattttagctcctgttagaaatctctagttgagtgtcacatatacacttcaaacacaacacattcaaatactgagaaatactcttcctctaaaacctattcctcactttgcaccctcctgttggctaaaggtgccccacatcccagagtgtccaagataaaaactgattttacttctcttttctcaccacttatgtaaatagatatctgcctctcatcatttctgccctgcaaaacatccctagctatgtgctttctgcctgtggcccactgtgacagcttccttctctcagtttagattgttatgcagtccattactcttctgcctcctaccatcaggctactattggagtcatcttcctgattcttacattcgatgacttcaatggttaagtgatgcattgcaatctttcttatatgattttctgctgctacaacagaatacctgaaactgttataaaaaatagaaatgtatttctaatagttccagaggctgacaagtccaacatcaaagcaccatcatctggctagtccttcttgcaccatcatctggcaagaccttcttgcacaaaggcaaacaactcaagagagtgaacccactcctgcaaggtcttaaaaatgtatcatggcaaaatttcttgagtggccccctttttaccacctgagaaaacctaaaacccttgggacagcatagaagactccttaatctgctcatgtctcccttttccagtgttagctccttttgctttcttttgtataccttgtgcccttgcccattgaaacaaacagctcacagttccccgagcatacctgcctttctacctgcctgggagctgccttctaataggctgtatataggctgtatcttgatgacttcctctcaactctccctctggaaaggtcccagtcattcatttgttaaggcccagtgaaaatttatttcccttcacaaaatatttttaggtatacatatatatgcatatgtatgctatctgtctattagatatatcttctttttggcctttatttttttattttttttatttttttgcaatagagtttcagtctgacacccaggctggagtgcagtgtcatgatcactgcaatcatgcagccttgacttcctgggctcaagcaatcctcccaccttagccttccgagtatctgggaatacaggtgcataccaccatgcccagctaatttttatatttttttgtggagacagagtcccattgtattacacagtatggtatcaaatttctgggctcaagcaatcctcctgcatcatcctcctaaagtgctgggattacatgcctgtggccactgtgtctggcattatccttgttaatttaatgcctacctcacttgtctttttcaaataatacttaatgaatgatttctggattgatacatccatgaatgaaatgatagtttgccaaaatacagaatattagagccttggtgtcaccttgagattatttagatcagaaaaggggatttttttatattagaaggttattcactgtattatttttaaaaagtttatttatctcaggtgtgttaattgttgagaatgtaacagaaaataagatatgaatggtctaagtgtttaggcattataataaagttgaagaaatgagaagaaatcccatggtgtttcttctcatgcattgataataaaacttctttattgattgcaactgtacattggcagcaccgccccaaaactggaaaataagatcaaattctcctttgttcttctttcatcaccttgcatttttattttcttgggcttattgttatgagtttggtttctagcttttacagcataagaaagaagtggaaatcaagacggaaagaagttactatagtgagaaggtgtcatgtcctgcaggccagtcatctcagagtctgactgcaacacccatgacataggccattctttttcttgcccacgaccctttccaaactaatatcaccagacttatattcctgtcctctttataaatgggggctgttgtctagcaggctagcttaccggaaaaaggactttctcagacgtgctttctcatcctgatggtttcctttaccagaagtgaggctgcaagcttcagcatgcgtttataacaaaaaagagagattgacttttttcatttaaattccatgtttctgcttggcatagtggcttatgcctgtaatcccagcactttgggaagctggggtgggagaatcgcttgagaacaggaggagttcatgaccagcctgggcaacataatgaaactactgtctctacaatatagtttttttctgagacaagatctcactctgttgcccagtatggagtccagtggcacaatctcagctcacttcagccttagcctcccaggttccagtgatcctcttgcctcagcctctggagtatctgagaccacaggtgtgcaccaccatgcccagatatatatttttttattttggtagagataatttttttatctttttgtaattgttgcatttttgccatgttggccaggctggtcttgaactccagacctcaggttgtctacctgtcttggcctctcaaaatgctgatattacagtgtaaaccactgcgtctggcctctgaaattttttttccaattagtgtgcttgtagtctcagctacttaggatggtgagtcagaaggattgcttgagcctaggagtttgaggatacagtgagctgtaatcaccccaccctgggtgacataatgagatgctgtctctataaaaaaataaacaagttataaattttcacataatcataaacatgtgatgatgtggatacttcattttcacatttaggtctttaatacagtgataccttctctttgggcaacagtcatcttcactctctactgtgttgataaagtttccactttgcccttgaagattttgtggcttaggaggaaacaattaaagggatgtccttcagcagaacagccaccctgtttaggaagaaactaattattgtgtgaaagggacagggtgatgttattgggtaatgatagtaagagataaaaccagttctcttgagctgttacttagattccataactgaggctgattttgcatccttggcactagatgttattcagctgacagccatggattcccaggggttccaagaaacccccaaactatctgtcacctttatgagtaggtaagaatgtatttttcttggagaggagtatctcctcaaagaagtctgtgatgtagaagaaaagatgaaaaatctctgctttggattcggaatgtcaggactactcactttgaacttaaggagaatttcttcttagtatgtacgagattaaaccatatggggttgccattttcttagacccatatagtcattttcatatggcttttatttggacaataagatcattgtgtagtccttttttccttttttcatctctcaaactttttctcctcttgggcatattgttccaggtttcctttgtggtttctagatcataagcattcatgcagtcacattacattccctcctaaattgtaagctctccaaagagaggggatatagctgctttatgttctcacccaactttgagtagggacaatagcaggaaacagaaagcattttcacagaaaggatggagtccatttgtgtcatatggatcttgtttgaaactttacctgtgtggcctggggtgaattaatacagctgtctttaaaatctagaactgaaacctcagcggattgccataaggattcccagaagttaggagctcctcagtaaatataagtatcctattctcttgtgtaatgaagctgacccacaggatgatgccaattatatccttggtattataagcatatgaacaacagttcatatttattgaggcctcactatgtgtaagacacaattgtgtgctttgggatatttgctcatacatgaaacaaatgtttaaataaaacagcgtgccccacactggagatgcagctgtcattagcattgacaccttcccagtatcatggtgcccatgtctccatgtgggttaatctaaagataggctcaggcatattaaattgggaaggttgtcttaggataattcaagcaggattaagtcaatagtgaatgaagagctagattaaatggggagtttgggacatgcatctctgctagatgaatttgagcaggaaacataggcaagacttatctgctttagttttcacagtaggaccatgagattacactactgtttattaactctattacagagatgtggaaactgagattaggatgattgaataactcagccagattaggaatagggctggtagtctttaatgcaagtctcatgggctatgctgcacatactcttaacaacttgctaccttcatggtaaaagcgaagaaccaacccaattccctttgccattccattcttgctatattagcctattttcacacttttataaagaaatacctaagactgggtaatttacaaaggaagaaggtttaactgatttacagttccgcatggcttgggaggcctcaggaaacttacaatcatggcagaaggtgaaagggaagaaaggcaccttcttcacaaggcagcaggaaggagagaagtgctgaggaaaggaggaagaaccccgtatacaaccatcagctctcatgagaactcactcactatcatgagaacattaggggggaactgcccccatgatctaaacaccccccacagggaccctcccccaacacatggggattacaatttggattacaattctagatgacatttgggacaggacatagagccagaccacatcacctaccatttaattagcttactcaactatcctgcaaacattccttagggagcaaaagggacacactcataaatggttttaacgtattttaaaagttatcaatattgtagtttaatcataatttttaaaatggtgcatctcatgtcattggctaggatcagcagattacatgctgtatcttggggtcaataattgctgcaagcactttattggagttgctgttagtagtcatgctgtctactttgtcctttcttctcccatttcaaccaacctggcagggattgacctcagtagtgagttgctagacatcaggagaagtcagaagtaagtggaagagggcctgctgtctagaagaacctccccccacccgcctggcccattgcagtgacaacacagatgcatgggagtaggttaaataattcttctctcattgatccattcattcatctttcatccatgaattaactattcatgactgattgttgttgactctgagcataccacaacaaagaggatgcacaaactgtcctgctgttactttagttatggggacagaagataaagcagtgatcaaatgcatgaaggacagaatttctgattgtgatcatagttttgagggaaatgaagcagtgataacatctaacgtgggttatgaggatctctgagatggagtgtccagggcatgtctttttgagggtgaggaatttaagcatcccagacacaagttctgacccaaacattagccttttcattgtgagaaagggcctcaggaaatttaataaatgtaatggtaggaattcacgataacactacaagaaaccaagctttgtttgtgaatggtggggttagaaggggtttgttgctagaaatcccatttgcaggttctcaggctggggttgaagtagaagcaacaatctcttgtcttttgccaagcaaagaacagtccctggtatctggcaaaagagaagtatcttcctctgaatcctggtgttggccataagccaaagttctatattaattttcctttttggttgagttgggaagcagttggatgattagctaatttttgctgaaatagaaggaaggcagattaaaaatatagaaaataactcctatttaatgattaaaaaatgagattaatcagacaaagttgtaatgaaaggtgaaataattttgttttataaaactgtaaaattttaggctgggcatggtggctgacacctgtaatcactttgggaagctgaggtgggaggattgctttagcccaggagttcaaggccagcctggtcaatatagggaaactacatctctacaaaaattatagaaattagccaagcatcatggtatgtgcctatggtcccagctactagttagtctgtggcaagtagaattgcttgaccctgagagatcaagggtacagtgtactctgtcctggttgatagagtgagaccctgtcacacatacacaaaaaaactataaaattttcatatgtaataatattgaagctaaagtggaaaatgtcataaaatatattttaatcctatggtataaatttctctctgttcattagttacaaaaatttgagcataaacactttcaaatacaaacctgtgcaaatgtcatagatggcaggtggtatatcactttatatatttaagctgtatgtgggaataaaaggataaaaataaaagttaaatttaaaattctaatgaaggaacatattagaactacattatggaggactttgttcatttatggtctgagcacagatgatgctaaacatgggttgtcaacttcagttggcatccatttaaaatgaacacactaaacaccttgagaagaaactgcatgaaaagtaaagagcattatccaagtgaacttcatatctcatcatttgcctgtgtttatatattaataaatacctacgtaattggtttaattaatcagtattttattttggtgttgaaataatgagtggctgagcatgccagatgtattcatctgatacattcttccagtcacagggtaggctgcattaggtggtaatgctttaccctgaattcatctgtaagttatgaagggaagtccataactctgatctcagagcatttattccattgttgataagccaagctgttgctctcacttagttgttaaggaacaaggctaactggaccttgatatgtaaagtatgtaaaatgtgtcctttcacgaaactctgaaacaaacaatgagaacaaccagaaaaaaatgctagagtcatacaaaagctgtctctattttttagtgatcattcctcaagctcttgtcagccactgagtgaccatagatggatttgcagttgttgccagtgtggctgattttgataggactaacataggaccagtgtagggagctatttattaagatgtttttgttagtcagtgtttacattttgggtgttctctgataacatacattaattcctattgcagtatttaataaagtgtaactgtgcctgttccacatgtctaaacatattcaaatatggagactttgttttggtctctattgcagatactaaatatcatattgtaattagagctatacagagatttagcatgtaagactggcaagtcttagaggctagcttttgtgattcagtaagaaggtggtgattggagtgaacaaatcacgtggggcacaattttgtgtttctggcttgagtgaccagtactttcctcttccctgcctcagtgcaatttcacattgtcttcattttgtgagatcaccctgtgtcttagcccatttagttttgcaattaaggaatctctgagactgggcaacatacagagaaaagaggtttatttggcttatggttctgcaggctgtacatcaatcatggcatcaggatctgcttcaagggtacagatcctagtgagggcatcagaaagcttgcactcacggtggaaggtgaagaggagctggtgtatgcagagattacatgtcaagagaagaagcaagagaatggggggaagtatgtgctaggctcttttaaacaatcagctttggggggaatgaaaagagcaataattcaggtaattcagcaattacctcaaggagagcatcaaggtgctcatgaggcatccacctctgtgacccaaacacctaccaaccaggcttcacctacaacattaggaatcaaatgtcaacctgacacttggagaggacaaacatccaaactctagcactctgtctccttaggtacatctttaatcttcagtgacttaccttcagtgactaagttctctttggaaaatgcaaatgtagtcatgtttcttttttgcttgtaatgtcttactgatttcctgttctttatagcttcatgttgcatcttcatcagttggtgaaccagttgatgaagacaagatcagcatcctgaagtatcttctacactttacttcaagattctcagaatgcatgttaactttactgcacagtgctgtttgccctggtctggtgtatctctgttaaccccagtgcacttttctctgatcttcctaaggctcttaccttcttagttcctacggcagtatttaataaagtgtaactagtgcctgttccaccttgtcattagtcgtttctgggactatcttgcctatatgagtatgggctactgtgggcaagtacaatgcctggcatgcagcaagctctctattaatgattgtttggctgctagagttctctttgctgttttcacatccattcttttgtcatcctcttttccctagtcgtctttccctgtacctttgcccttgtttctccatgaatcaatataaatagtataagctttgtgcaaaacagaccttcacgcttgtcttatgtcttcattgctttcttctgcatactaaaaggccattaccttcctctctctgactctcaatttcctaatctgtataattttgatagttatctcccctgtctgctatttctgacgttggcgtgaacacgaatatgcgaagtaccagactttcactcctgtctcatgattgcattgccttcttctgcatactaaaaggccattaccttccctctatgagtctcaatttcctcatctgtatacttttgatagttgtttctactgtctgccattgctgtgacaatggcacaactcagatatgcaaagtacctttgggctaaatgtgaacaaaaccttcaacctgctgcatgataatctcacctttgcttgactggctagctctgttttcttggtagttggatgaagaacatgccaacaatgttatggacaatattgcttacaatatagatgatcccctattggtaaatagcatcatggccaggaaaaaccataaagacttgaaagaacctagtgggaataccaccccacctcaggcttcctggagggcaagttttggagtcactttgcagctgctatgttcactctagggacaatggaaactctgctcatggagtatttacagggaatattggctgctgtgaaggctgggacttcaatgccaaggaatacccaactcctgtggatatggaccttatagagatctttgcatctcagctaacctttgtggagtagatggttcccacatgccagctgcagccttcctgatgagctgagggtcttgtctatattgttttgagttggttggcaccatgttgactttgaggagtcttgttattctgcatgtttagtgtaacctaagaagatccttactgaatattaaagagcaaagacaagtgtccctctaacagaatactggctaaacaattggtattctctctgatgcttcttacctgcttgaaagctcttttctttcatccttcatagtcacttcttacatctgacacaaccttcagctttgcattattccttcattatctttgtttgccccacatttcttaaaaacatagtttttaaattgtgaccaaatgtacatgacataaaatgtaccatttttatatgtacagttgaggggtattaagtgcattcacatggttttgcaaatgtacctttttttggtcatcctgtgtccttattgtactctttcctggtttatgatgcagtgtcttatatatgatgtaataaatgtcccctgggtatctcagccttgtatactctggtcttctgttatatcatgtacaccttgagggtagagattgtgccctactaatcttcctccttcatcacatgaaatattgtctctgcacagtaaatattcttcagtctcctttctgtcatgtttttctgtataccatgacacttatttgccaaggatcactttgaccctctaggcaaaatttcaccattggtaacaatgctaaagttcacataaatcttaagttgaatctgaattttaaatatttgaatatgttttgagtcccaaatttgtccaaagcatagccacagtgcccagctatttattttctgaatttttttttggtagagattgggtcttgctatgttcccaaggctggtctggaactcctaggttcaagcaaccctccctccttgacctctcaaagtattaggatcacagatatgagccaccatacatggccaaagtttcatattattttagaaggtgatgagtgttctgaagtgaactagagaaggatacgtgttatcagagttgctgaggaagttgcagtactttaagtagggtgatcagtgacaacatcaatgaaaacagaatgtggcagtcgagaatttaaagagttaagggaagaagccacgatgatatatgagaaggatgttccaggcagagggaagagccagtgccaaggccctggggtgggaacatccctgttctctttagcacagagcagtgtaattgtctgctctcatgctgccagtaaaggtatacccaagactgtgtcacttataaaggagaggtttaatagtctcactgctctacatggctagggaagcctcacaatcatagtggaaggcaaggagaagcaaagtcatgtcttacatggatggcggcaggcaagagagagcatgtgcaggggaactttcctctataaaaccatcagatcttatgagacttactcactgtcatgagaacagtataggaaatatccatccccatgattctgttacctcccattacttccttcccacaattatgggagctacaattcaatatgagatttgggtggggacacagccaaaccatatcaagcagtaagatacctgttgccagaaaagagtgaatagtaggtatcagagtagagcaacactattgagatatttgtaattctgagaaccaggaagaacaaatggaaagatttcacctgataaatcatgtgtcagagtgtgttttaaagcaggactttgcttagctgaggcttacctgtcagggcaaggatgggatgagggaaaccagttagaatactgatgcaagagtcaagatgaaaacctacaactggaaactgaggagaagtggctcggttttttaacacatttgaaataaaatttgctcatgatttggatgtggagtgtgggagatggaaggaagtccagagtttttggcctaaacactggagaaggtagaggtgatcacaggtgacattggaggatgagctggcagagatattcttcagacattattagatttgaatgtttgagtttgaaaagtctatgagacatcaaacataatatatcgcataaggacatgtatgacaaagtctgaagttcaagagagaaatctgtgctgaagagaaaaaatatcagcctagatagtgtcgatggtatctaaagttatgaggctgaatgaaattatcaagagagttctgtggacagagaaggcaaagggcaaaagaccaaggctggagtgactggtagtcataggaggacctggaatggaaatgaaaataattgtatacagtgtaaaagaatatctggtaacattgaagtcaatggttgaaaaaggcatttcagtgagacagaggtagtcaactaggtgtaattcaaataagtctcaaatgagcatctattgctaagatttccactacagaggcaaccaaaaagtgtcatcatgcttttgtctgtctgattgtggcagctgagattgaatagaggtaggaagaggtgaaaaaagaatgaggaaaatagaagacatagcaatgcaaatgtcattgttgacctttactggaaaagtaataattttagtggagtttgggggtaaaagcacaattggagcagctttcagagagaataaggtcaataaaattgggatcaatatggataaatattttcaaggatattttcagaaaaggaggcatatatattaaatataatattatatcatatataatatatatgataggaggtaactgaatcatggggatggagttttcccatgctgttcttgtgatagtaagtctcataagatattgtattatatattatatattaatatcaattagttaatattaacattaatattatattatatataattatatataatgtttgtgtatttcagatgagaaaattgttttatcgcttttaaggtggggaatctaaccacatgtctgtgtgctgtagggttgtaaagtttatttctcactcatgttcaaggttcactaagggttgactgtggctgtttctgtgtcttcttaattctgggactcaggctgatatagaagactcatttcttattattattttggcaaagggcaaaaatgtgcataaccgcatttttatctcttaaggtcctcacttgcaagtagcccttttaatttctgttcatctttcactagccaaagcaagtcaaatagctataactgaagttctaaactgagttagtgtaattctttccagttaggggcagggcaatattgaaagagtgtatttgtccctgtgagaggggaggaaatttctttatacaataatacaacatacaagaggaaagcaattctgatgatgtagcaagagaggagtattttgttgttggattgtggggagtcgatagaatttgaagagtaagagtcagctttagatatgatttatttcattcctctcttatgaaaagagggggcacagaagatgggaatgttattgtcacatgggtaaatgggttggtggtggtttgtgtatgttttcttcagattgttagaattttttcggtgtagtaagaagccaggtcatacgctaacagggaagacggagcaggaaggattggggattagacgagggagaagaaggtgccaactatttagcagagcctttgagagaattcatcagagaagtttattattccaggcatctccatgagcctactggaggtttgtggtcctgagtttaacatgagacaagtcagcatgattgaatatcttttttcacctggctaattggcaaaggcgtagccactgcatgctgggtggagaggtagatttcaccaggtttggtgttgtgccaaggaagagtcaaaaattaagactggattagaactgaaggtgtctgaaggatggtggatctgatatgactccacaactctaagaaatgaagatccagtgccaccatccccatcatggaaatgacaaatgaatcaaacaaaatcatttatcactttgtacaagattcggagggcttgtgtgtctatgatctcaggcctcagaaagagtaaattggttatttttttctcacataactctgtgtgtgtgcattagtacaattttttatttttgccctagaatgtaaacataaatttgtcaaattaaagcagtaaattggaaaaaaaatatacagttttgtattatctgtagaaaaaatgttaccacagctatgtagactatgaaaatggaaaaatttattatgtatttaatttttacccaagagcagtaaaatgaagacacctatataattaggcaggtgactgttaaaatatttgattttttgttgaaattccttggctcagaaaacaggtttcatgccatgctgaaaaattacttagtttgatgaaaaagtgaacaagacatgacagtgaaatcatataatgttcagacaggaaatagcaaaagtctattttttcaataactggctggagtaagttgtcctcattttgggtcaagatcttattttggtgtctcagctgaagataccctcttcacaacctattaggtattgtgacattgattaagtattatcaagcagaaagtatttgtaggaaattctttgtactgggtaggtaaggcaatcgctaccacaggggcatagattttgaaacatttcaggaggatccaaagtcttactgagaaacctaaggcagtcagcaattagaggataagataatggatgattaactactactgtgtgtggggtagacaattagagaacaatgcaacacacatgttttaaggtgctgatcatgagtttgaacaatggtgaaaaatggaagaaaacatcactggcatgggctgacgctgtcaggggtggtgtgttttctcatgtgctgttatcctctcatcagtgttgagttggatagtattcccaggaatggctgcttggcttcacttctcttaacagagaattgctctaccccataaatctgcagacacacctggatcttgaatttccattttactctggaagatgtacagctgcaaacaaaatcaaatcacatttagcgcctttctggaacttccccaagtactcagtagtcattctagctcacatcttaagtcccctagggttcaataagtatactaaatgcatatttgaaccatttccaaaatctaattcactttgatcaacagttgtttcctatgaatttgctgtgttttcttcaatatagaatactttctgtgattaatctttcagtagaccaaaggtgaggtagattacattaaattctaaatcatgaatgattcattcttttactgaaagtaaacacatctatcatattgactccatatcatattctgttgtatatcctcacttagatgtctttattattttttagacagcttatatgattgtttagagcttcaggcagtttacatagacaaaatatctgaataaaagtacaatgatcatattttattttgtcagtttaaaatgatgtttaatgattttaatgccagagaaaacgtgtgtgtgtgcatgtatgtgcaaacatattttaaagtaatggtttactgagaggattttttttctctttgtatgactaagatatctgaaattctgccaaaagttgttgaaatacgcccttcttaaaatgtcaatatgtctataacatatttttatgatatttcagtattagatatgttcattaccccatgtactaattaggtcttatcttgtgatgatgagtcattagacctattatattgaaaatatttttaggtagaaatttatatagtctctgagtaaaatcttatgttgagtatgtgggtaagttgccttgggatcacctgattgtatttttattgttgctgacttttcatcattttattaatttgggaataaggacttcttttttatggtgtagttctgtatcaccttcccttagattatattgtacaatgaacaggcagaagatactaagatcttattaaaactagaactttgaacctaaatggggatttatgaagctaaattagcctaattgcatattacaatgaccacagcatattaatcaaacatgtgacccttacatttgcaatttaatgatctttaatatgaaaagcattttgtaatataatctgcttgatgaacatttgctatttttactaatttttacttatctaattgttaattcatgcaatttatctaattcttagtaatctatatgattcaagcctcttatagatttttatctctacccagtttttcatccagctgtctttctggttatctctgccttggtgtgcttgagtattatttctgattctgtgactccaatgtactttgaagtgtctgaacttgaggtggcagaatcaaggtacttctatagaggccactgaattccttttctcatgatgaggtacaggaaccatttctcaaagctgccaaaacactgccccttagtctatgcaaatcagccagtacaaatgcatgtgactcaatcaacatcatgaaaccactttttggaatgcctgatgttgacaaaatgtgatcttgtgacaatgtgatacatttatttaagccaccttgtggtatcaaattggcaccattgacaacatacttcttagacgctaagtgcaataatttgttgcctctcattttcctacactgctttacttcattaaatctgcatcattaaaaatatttatagcattgctgaagtcacttcccaggagctaaggaatgtctccatctgtatgctgatccagttcctgctggcatttgcttggatgcagaggccatccatctcttgccattgatatttgtcaattgatgctttttttccttctttcctggtgacttaggaaaggttctgatgctatatctgctacagatgccaccatggccagctaattttttaatttttgtttttgtagagacggagtattgctgtgttgcccaggatagtcatccactcctggcctcaagtgatcctcctggctagtcctcccaaagtgccaggattggaagtgtgagacacctctcccagccccagtgcttgatatttaagagcttcaggcatggaaagattttgtctgcctgccacagccttccatcattttgggatgtatttgcttgagacagctgaatatgtgacaacctgaactgtggttgctggcaattggaaaatagtagattgttctgttgatctgctgggagaagtacagcagcctgcagaggaatagaagcccaggggttttatctggcacagaattactctagagagccatgtaaaaaatttaatttctgtttttataatttattgttattatttttagagacagggtcttgctctgtctctcagattggagtaggataatcatagctcactgcaaccttgaaatcctcaggttgagtgatcctcccacctcatcttctcaagtagttgggatgacaggcgtgcaccactatacctagctaatttctctatttttatttttgtagaaacagtatctctctctgctgcccagtctgttcttgaactcttggcctcacgtaatcctcccatctagttctcctgaagtcctggggttatgggtgtgatcgtgcctatccatttggttgctgtttttaaatttgtacctttattgtcatgctaaataggaattctgatggtactgttggctgaatagggtcaactggaacacacatttttgttttacaggtaaatacgatgaaacttaaaatgtagctaatgttattcctgaaacgaatatgtgaagttctaatttagggacaaaaattaaaaaaaaaaaaaacatgttgcatgtattaaacaccttgttggctatgtttcatctgtaatttcatttggaggtagccattgcttcttaactcatgctaaccgtgctttagagctattgatttttagcagctactatgctttcatgcttgcagatcatttatctctttggaaactctatttgatgacaaagctggctctgttacagagtaatggtaaaagaaatgacttaccagaatttcaagtgaaatgtgcaacatacatgatgatgcatggtgactgctataactatttcctaatgttgttatttaacagccatgaaagcatccaactgaaataggattgaatggcttagttagctcaatgtttttgaaagctttctcagtaaagcatggtgccaggcaccaagtggttccttatagaggagccagagttaattttgatgatgttttaaaaacgctgctagaaattgggtggtgttttccaaatgatcttcctagtaattatttatgctatgaatcagaaaggttaccatctctctggatggaaatggatagtcatatgtgcacaaattcagggatttggcctcctatgataaagccctgtcttccccctcatttatgtgatgattgtgcactatctgaatgatgagaaacccattggccagttttcacttgtgcatggctggaggtgcttgctgcagctctgtgatgtcctgagccagcatgcttgtggagttccagtctgctgcatgaacaattgaagaaacatgatcttcctaaatttttcacaagctgctaaatgagtgatttgtgtttcttttgaattcatgctgcaactggaaatgcttgctccttcccaggttattgctcaatctacatgccatttgaggatgcagataattactgaatctttatggaagcatcccatcttagtccagatttcccttttcacagaccaaaaggtcaaagtcagacttggcagacaacacagcttcagtctcatggggggatttctttgtcttatcaacctcagtcatgggctttccagccattataatttcacatgtaatatggagggtattgttccaagaaagtgtggtgcctcagtagggttggaggaggcacatgcagctgatatagctaaagaagagtgtgttaaaagtggaaggaggcaaattaaaagcactaaggaaagtttcttttacacaccacagaaaggtttacaaaacatcgaggaagcttcagacccaatccaggtactgcttttacttctgaactatgtcataatttgtgatatcagaatattctatggaatctatggatacctgcagaaatagtttgctgttgttcccattctgcattatacatttataagcagttgctgtatcatgggatacataatgttctttaatcctaataggggcatcagttctaaatataaccaaaacaattgtgaaaggcacacatgcacaggttggcatatagagatggagatggccgatacgttgtgttttgtacagatgggaatgctttctgtgtcctgcccccacactgcaggacagctgacaggtagtccaaatgcccatgtagacagctggactccagacagcttgctggtactgtctggcacgccttcaagtcctgactttcttgggtccctaatggaatttacattacctgaaatttccgggagtttgtgaggctggctaaacagattccctaaataactggagatgtgcagtcagagagcgaatagacaaagaaggatgcggtggctgtcagtgtattcattttcttttgctgcatatttgattactgcaaatttagtggcttaaaatgacacacttttgtcatctcacaattcttgtgggtcaggtttctgggcatgtctgaactggatttagtgctcagtgccacacggggatgaaatcaaggtgtcggctgggtagcatgattctctgaaggttcatagtcctcttccaagctcactcaggaattggcagaattagtttatttctgttgtaggatcgaagtcccctttcctttctctctgtcagcaggagctgatttcagctcatagaggtcccccaagcagcttgttgccatgcagccttctcagggaccatcttccaatatgttcatgcatgcatgcctgcatcttcatgtccagcaggggaatctcttgctccagtctgctaagaaaaggaaaaatcttagataacataaccaaggcaatagcatcgcattccatttcctaggtaacataacatactcacaggatgacttctaacaacttcataagtccagctcatattcaccttcctgggattaaaggagggcatggcttatcgggtccttccaacttataaatactccaatatataaatttcccagggcttctataacatattaccacaaacagggtagcttaaaacaacagaaatgtattccctccagttctggaggccagaaaaccaaaatccaggtgttgtcagggttggtttcttctgcaccttctgagggagaatctgttcctgcctctcctactttatgggggctgccagtaatttttggcttttcttggcagtgtcacttcaatactgtcttcatctttccaaggccttcttctctgcatatgtttctggatgctctcttcttctaaagacacagtcattggatcgagggaccattgcaaatacatgatcattttatctctaaggagattacatagtcacatctgcaaagaccctgcagtagtacctccttatccattgttttgttctccgtggtttcagttcccggtgatcatttaatctcttggcttaatcagttaactcttgagagattaagagttaatctcttactgagcataatttataaattaaactttattatgggcatgtatacataggagaaaacatagtatctatagaatttggtactagctgcagcttcacatcttggagcctatcctcacgcataacaatctggggtgttatgtatttccaaatagggtcacattctgagaatctggtagatgtgggtttctgcaacattattcaacacaatacaccctgtcatgctttgcctgtgacctgacactgcccaattctctggtataatcttgcagcagactctcctttaccttttctggaatatttccttacaactctctttctgactccttgactcccaattcagatcatctaaaactaagagtaatatttagggattatcttgctgaccattagagaagatggggtcactaacagatagatagataggtaggtaggcagatagatagatagatagatagatagatagatagatagatagattgatagataatagatgtgaatcgatagatggaaatggatggatagtaagatgatagctaggtgatatatgtatatatagacagatagatagaaagatagatagatagatagatagatgatagagatggatagatatagatacatagataaatgatagctcataatggatagatataggtagatagaggtggagagataaaagacagaaagtaagacatatagatatagataagcagataggtgatagatagatagatagatagatagatagatagatagatagatagaaggtagagatagaaacaggtagacaggtatatagatgatgggtatatagatgagagagatagatagatagatagatagatagatagatagatagataggcaggcaggcagacagagagacagatacataggcaggtaggtaggtagaggacagagggatagataggtagacagagaaatagattgtagattggagagacggatagatagacatcttaattcctgtgcgccaatccttctctctatagctaattataatcatacatgtatatggttacatttctattagtagcatttcacagtgggaattcagtgatttagtgattactgaattaattgttgtatgaggctccctgacagcaaacactgagtctttttgttcactatcctcagtgctatcattttacagtaaatggtggaggaaacgtaacttcctaccaaaagcattttgtggcgctgaaataggagaaagtgagattctttactccatttccaaaatcatggatactggctccaacatcagaatttacatggtgcctaaagaattcatcctattgcattgaatacattcatgcacatgagtattttctgagcaattttggtttccaatgagatactcatctccagacagcactggaccttactaagatgactaattattagttgacatgtgaatactatgtgctaggtgaatgtgtgaaaaatgtcattggctggaagggcttttctcaaattgtccaactttgcagccgtggactaataaccatttttcatgaaccaactctgtctcttacatatttgtttaggttgggttaaagtttatttcaattgaacgtgtacatagagttgttgtatttaggagactttctgaaataattctcaggcaatcccttgaggtagaaaaacatctccttgctttactgtaaatccatttccatgcttttttctattcatagaggccacctgtattccttggcttatgactttagagactgacacttgttgcctacaagtggctaaatgcaggaaggacagtacccctttgaacttaatttgtttcccattggatctatggaaccattccctatgtgctaaggccataaaataatccctgaggagatggattactgttcagcttattgaaagagttagcataaatctacccagatctctccttagatttttggctgttctgggttggcaatcatgttcacatcttttcctttctttttttttcattatttttaaatttaagcatatttatgcagtagttagcaatgttttgatacatataaggcatgctgatcagatcaaggtattcggcatatccatcatctcaaacattgatcatttatttgtatagaaacttccaatagcctctttctagccattggatacgatacatccttgttaactacagggttatagaatactagaacttattcttgatatctggctggaattttgtattctttcacaaatctttctctatccctttcctttccttctttccttcccagcccctaatatcctacgttctattctttcctcctatgagattaacgttttagatgagaaattcataacaggggatactacctaaatactatgttgggaagttacctgttagaggactgggtcctctcttaagaagtgacttcccagtatagtatctaggtagcatccctcagcctgcagactccatgaggccaagaatgcttttagtgtggcccaacacaaatttgcaacctttcttaaaacattgtgagtttttttgtgtgatttttaaaaattagctcatcagcaattgttggtgtattttacgtgtggcccaagacaattcttcttcttccagtatgacctaaagaagccaaaagattggacaccccggcagagggaggaggttttatctaaatcatgaaaactggttggaatattggccagcagatgccgccatggcagggaattgggatttcttgttaaaggtgttaccatttgagcatattgtaacattatttattactttcttatttactctttttcatgctgttaagtattttggggtgaattcagtaatttcccatcccttcaattgaatgtagtagtaatagtaataacaataacaattctaaacctggagagattttataaatacctaaaattgcatgtaattatgaaagaaatgaaatcattaagctaggaatcactcttttagtgaatctcaaaataacatgctttttttaatgaaaaaaaagctaattatttaaggtaaatctgtaaacacctagaggtacattaagcttacatgttggcccaaagtgatggtttatgaatttgtgaaagagtgaaaggattggcttagagtcattactgtatgggattaaatacttgcgttcaacaaaaatctcatcatataatcaccacacagtattattttctgaagaaacataatgctaatgcaaacataaatggatattaaaatggagacaaattagaaatcatcaggatgtgtttttaaaagctaggtagtattttttgattatagaattaggtaaaggctctgaatccttgagagcaacaacttggaatacttaaaattatctgtattattaacaatggaggactgtgttcaaaacacaagatatcttaagaagaatttgcatcaagtttggcatcagaatcttgccaggtgaattggctgtatttttaaagtaatattgtgatgtttatgggacccacctgcagtgaaataggtctctttcattccacacctggatacagcaatctctttgcattgctcttcttcttctcttctgaaatgccatccttctttgtgaactacaatttctaacacttagtccgtgccttctaaacaaaagtgtcagttctctgaatgccatttattcttcgtcgaataacatgtttagttataattcttattttctttactgcatcaaagatcttaagacataatcaatgatgtattcctctctctgttttatatttcattttgtgtgagtaaaacaaaacttccttgccagagattaacttaagaccgtgttctgactatttgtttaaaagatgatgttatgccatgaagtgtttgacttctaggtttgaaccccaaaaccccaatagcttgatctcattgactaagttatttaaggattctgtgctgcagttgcctcatctataaagttaggacaaaaatactaccttaccacttttaagaaggctacaaagtatttggaatagtgccttgaatgcattaatcaaatactgcagttcaatacttaatattgtcattattaaatatctgttgccataggaagaccactggaataggagtaaaaagggaaggtgcaaattttcactccagcaccagtagcatgtattataaacacaatgatacagcatagtccttactatataaaaaccaggtgggtcactaactagtgctagaatgttctagggaagtcattcttattttctcttcttcaggctcttaacctataaaatgcagataccaagtaaaaggaactagggcttcttggagaaatggctgatttgagaactggggcaggaaatataaaaggtaagcttgtagtgtgtgttgtagtgccagaaaggaggacaatgctaagcccgcatgcacacgcacacacacacacacacacacacacacacacgcacaatgacatggtcatgacactgcatacaagggccaacttagagagcattccatggccctctttgggacaactggagtaacaaaataaataacgtagttttgagttataactcaaagtgtagaatacatatccacaatccaatatttgatgtagatgactgaataaattagcatgatatagtaatttcctaatgctactatagaaaattacattatttttggcataaaacagcacaaaggtatctcaccattttgttttgttagacatcttcattttaaaggttagaagtcccacatgggtctccctaggctgaaatcaaactgtccatagaattgattgcttttgagacctgttgggggaaattcatttccttgttttccattcatagaaggcacctgcatttcttggctcattctttttgcttgatgtgcaaagccagcagtgcagtgtcttcagttgcttctctgactgcactcctgcttccttcttgttcttgaaggaactgttatgattatattggggccacctggataattcacaataatcttattttaaaatcaggcaatgcacaactttaattccatctgcgaactcataacatattggcagattgaggaaattaggatgtcgatatcctgggggaagtatcattattttccttaccactggagagatgagaagaatttctcatgaagaggcatttaaaataatttatataggtatttatcccttaagaagttggagtataaatttttatttatttatttatttatttattttttactctttgaattcatttttacattttggagatgaagtcactcaatattgcccagactgttctcaaactcctggcctctggcaatccttctgcttcagcctcccagtgttttgggattataggtataaggcactgcacctggccataaatctcctttttttattattatactttaagttttagggtacatgtgcacaacgtgcaggttagttacatatgtatacatgtgccatgttggtgtgctgcacccattaactcttcatttaatgttaggtatatctcctaatgctattcctaccccctacccccaccccacaacaggccccagtgtgtgatgttccccttcctgtgtccatgtgttctcattgttcagttcccacctgtgagtgagaacatgtggtgtttggttttttgtccttgcgatagtttgctgagaatgatggtttccagcttcatccatgtccctacaaaggacatgaactcatcatttttatggctgcatagtattccatggtgtatatgtgccacattttcttaatccaggctatcattgttggacatttgggttggttccaagtctttgctattgtgaataatgccgcaataaacgtacgtgtgcacgtgtctttatagcagcatgatttataatcctttgggtatatacccagtaatgggattgctgggtcaattggtatttctagttctagatccctgagaaatcgccacactgacttccacaatggttgaactagtctacaatcccaccaacactgtaaaagtgttcctatttctccacatcctctccagcacctgttgtttcctgactttttaatgatcaccattctaactggtgtgagatggtatctcattgtggttttgatttgcattgctctgatggctattgatgatgagcattttttcatgtgtctgttggctgcataaatgtcttcttttgagaagtgtctgtccatatccttcgcccactttttgatgggtttttttgtttttctcttgtaaacttgtttaagttacttgtagattcggatatcagccctttgtcagatgggtcgattgcaaaaattttctcccattctgtaggttgcctgttcactctgatggtagtttgttttgctgtgcagaagctctttagtttaattagatcccatttgtcaattttggcttttgttgccattgctcttggtgttttagacatgaagtccttgcccatgcctatgtcctgaatgatattgcctaggttttcttctagggtttttatggttttaggtctaacatttaagtctttaatccatcttgaattaatttttgtataaggtgtaaggaagggatccagtttcagctttcacatacggctaaccagttttcccagcatcatttattaaatagggaatcctttccccattgctggtttttctcaggtttgacaaagatcagatggttgtagatatgcggcattatttctgagggctctgttctgttccattaatctatatctctgttttggtaccagtaccgtactgttttggttactgtagccttgtagtatagtttgaagtcaggtagcgtgatgcctccagctttgttcttttggcttaggattgttttggcaatgcaggctcttttttggttccatatgaactttaaagtagttttttttccaattctgtgaagaaagtcattggtagcttgatggggatggcactgaatctataaattaccttgggcagtatggccattttcacaatattgattcttcctacccatgagcatggaatgttcttccatttgtttgtatcctcttttatttcattgaggagtggtctgtagttctccttgaagaggtccttcacatcccttgtaagttggattcctaggtattttattctctttgaagcaattgtgaatgggagttcactcatgatttggctctctgtctcttattggtatataagaatgcttgtgacttttgcacattgattttgtatcctgagactttgctgaagttgcctatcagcttaaagagattttcagctgagacaatgggtttttctaaagatacaatcatgtcatctgcaaacaaggacaatttgacttcctcttttcctaattgaataccatttatttccttcttctgcctgattgccctggccagaacttccaacactgtgttgaattggagtggtgagagagggcaaccctgtcttgtgccagttttcaaagggaatgcttccagtttttgcccattctgtatgatattggctgtaggtttgtcatagatagctcttattattttgatatacatcccatcaatacctgatttattgagagtttttagcattaaaggttgttgaagtttgtcaaaggccttttctgcatttattgagataatcatatggtttttattgttggttctgtttatatgctggattacatttattgatttgcatatatagaaccaggcttgcatcccagggatgaagcccacttaatcatggtggataagctttttgatgtgctgctgggtttggtttgccagtattttattgaggatgtttgcatcgatgttcctcagggatattggtctaaaattctcttttttttgttgtgtctctgccaggctttggtagcaggatgatgctggcctcataaaacgagttagggaggattccctctttttctattgattggaatagtttcagaaggaatggtaccagctcctccttgtacctctggtagaattcggctgtgaatccatcaggtcctggactttttttggttggtaagctattaattattgcctgaatttcagagcctgttattggtctgttcagagattcaacttcttcatggtttagacttgggcgggtgtatgtgtcgaggaatttatccatttcttgtagattttctagtttgtttgtgtagaggtgtttatagtattctctgatggcagtttgtatttctttgggatcggtggtgatatcccctttatcattttttattgcgtttatttgtttcttctctctttttttaggtttaactgtgcatgatatcttccttccaaagagtgtacagtattgaaagggtagacaaacggtatctttatagtggaggaacctgacaaacaataactcagacagatcagactcaatatccacagcgataaactatttttactgtatgcattcttgataggctgtgagaagaaaggcattttctttctcccttcccaaaaattcataattagatctcagcttaatcacggtagacatgaaagacatcccagttgtgcaatactctataaaatgcctgacaaaaattcctcaaaaccatcaaggttatcagaagcaaggaaaacatgagaaacagttatagccaagaggcacctaagaagacaagatgactaaaatgtcacatgggattctagattgaatcctggtacagaaaaaggacatgagctacaaactatgagaatctgaacaaaatgcaggctttactgaattatagtgtttccatcttggttcattaattataagaaatatgtcacactgatgtcaatgttattaataggggaaactgactgtcaggcatatggcagttctctttactgtcttcacaattttctgcaaatctaaaactttccaaaattacaagttaatttaaaacaaatggacaaatggaaatgaaggtattatacctttttttctctaattcttggagaggctttgcagatgctactgtgtaatatccataaagttgccttgaaaatttcttaaattttaagtttaaatgagattttgcttaaaaataaaacacgcacaatgtctagtcatttttgtttaataataatgcaagtgattaccttggtgtcttcctgggtaagatctttctgtgataagtggttggagtcatagagtaaatagtcaacacactcttgttttcttgagtagcatgattatatggccaaataattgacatgcaaatcatagtgtcatcagggatacgtacaaatgttcatgcaacacagacttcttctaatgagtacggtattaaacagttcagtatagcattgagctgaggaacatgtcatagagattctggcacttgtacttggtgctcaaaggttttacaaagttagagaggaaatttctggaggggaagcttagagacatcacattctctgaatcaaggaagagaatacttcatgagaaaaatctgagtggaagaaaaatgtttgagaaatcatgaaaaataccactgccagctatgatatgagctaacatttatggatcaccagttgtatgcaagaaaacatttacatgttaccagggaatcagaaggattgaaagagagtaataagcaatatttatgtatatgttatttttgtttgtttgcttgtttgttttgagatggaatcttgttctgtcacccaggctagactgcagtgatgtaatcttggctcactgcaatttctgcctccctggttcaagcagttcttctgccttggcctcctatgtcttgggattacaggcatgtggcatcacacctagcaaattttcctgtttttagtagagatagggtttcaccaatatgattctttcaaagtgctcattacatcagaaagtccctcgtggaaatagttcctcatagaaaggaaacagtctcgtgtttcttggccttagttcttttaggatgtaatgaggataatattttgcttaccctaactacataggtatttcacaatctaggttgataatctcatttaaaaaaaaatatatatatatatatatatatatgtatgattgtgtgtagtgtgtatatatatacacttatattgattgcgtgtgatgtgtatatatatacatatgtgtatgtgtatatatacacaatcagatatatgtgtatatgtatgcacatatatatacatacacacatatgtgtatatatatacacacatatatacatatacacatatgtgtatatatatatacctgttcaaagttattcggttttgaatacaacattttgagaggtatcttagggcaattaaaagtcaattttatgtgtatatatatatatatatatatatatatatatatatatatatatctgtagcggtctatatatgcgtgtgtgtgtagaagttattaggtttttgtttgtttgtttcattgttgttttttgagatggagtctcgctctgtaatccaggctatagtatagtgtcataaccttgcctctctgcaatatccgccacctaggtgctagggattcttgagcctagtctcccaattagctgtgattacaggcatatgccaccatgcctgtataatttttgtatttttagtagagatagggtttcaccgtgttggccaggcaggccaacagatagatgtgtgtgtgtgcgcgtgtgagtaatacatataaacatctttgggtgtattagatttttaatacaacatttcaagaaacatcttagggcaaataaatgtcaattttcttttcaaaatgacttttcttaataaaatgtatttaaaatacctagcaaaatataatattaagttagttctcatttttaaatacactgtgatttaatcacaagctcacagatccttagagatgatattgtctatcagctgaaaattcaaaaaaaatgggagatgctcatgtaaatatactaagatttgtatttcattcctgaaaacagaaacacttcagtggtaaaatttgcaacaaaaaaaaatgcttatggaagcttagacaatgctctaggactctaatagtaagcacaggaatatgtcaggaagccatacagtctttagattcattttgattcctacctgaaaaagtgtcaattcttgctaaatgtagcaaagcaacaaagaaaaattattattcacctgtttctctcagtgtttttcctaaccttaaccctatttcctaaccctattttaagttatttcctaaccctttcctatttccattattataataaagcatttttgatctggtagaaaattagaattagaccttgcttttactgtcatcacaatagcattttatcaagtttttttaaaaaaatagcaaatggcagaattattatatattgtatgttaatcgaaattattttttaccatgttatgaattataatttatatctattctcaaaactaaagaagatgcaacattgcatttgcacacttgagaggagaattagttccacatgctacatagagagctgtatttatcattgtttttcacagctggtatgactgtgactattataatagaggtgagcttgcaagccaaaaatatgtgattcatccaacagttatttaccatgtaacttatatgttctggatgtttaggtagttattacaaattaggaaatatggtgttgaaaatcacaggaaacacctttgttttctttttcctagccatttagcaaagagacctaattcaacaaggtatcatgttaaatattataattcatttggtgatgaaaaatgccaactacagtgaataattgaggaactcaagtttatttaggaatataatgctgggatgaacagggaatgcctttcttaggaaatataatttaggctgaccaataaaaatttgtcttacaggagaaaatgtgccttgcaagtagggggaacagcagaattcccaaaagtcctaaaggcaacctgatgatgaaatgagttaagccatgttcacagtggtgtattagttgacttttgctacataaggaaccatctcaaagctaagcatctcaaacaacttttatttagcaaagcatctcaaacaacctctatgtaggttatgattcttggttgggaatctgggctgtgctcatctgggaggctcttcagcctagagtcaacatccaggtcagttgggtgctcactggccaagcactatctcaacatggtgcttgtcagtgctcatgtggaatatcatcctctaacaggctagtgaggactcttcatggaaacttgtcagagttgcatgtagatatgttcaagttctcttacagtgaaagctacatagtgtcagtgtcacctccctgatccagaatgtccaaataagtaaatccagaaagatacaaatgaatgggcagtttccaggggctgggggaaagaggaaatggagagtgaccactaactggtacagtatatttgggggcatggggaatcatgaaaacgttctgccattcgatattgtttattattgcacagatccatgaatacattaaaaaccactggattgcatactttgacatagtgatatgtatgatacagtaattatatctcagttaagctatttatcaacctatctctatctaatcaatctatcaaccaaataaattaagacagcctatgtatagagacaaatagaccaggagccagtcactgtggctcacacctgtaaacctagcactttgggaggccaaggtgggtgtatcaccttaggtcctgagtttgagaacagcctggccaatgcggtgaaacctcacctctattaaaaatacaaaaattagccgggaatggtggcgcaggcctgtaatcccagatatttggggaagctgaggcagcagaatcacttgaatcagaaggcagagctttcagtgagccaaaactgcaccatttcactccagcctgggtgacagagcaagactccatcttaaaaaaaaaaaagacagaacagaacagaggaaggtaggcagaaacagactctggtagatgtaaaacttggcatgtaagtgaagagccataatacctatgtagctgaaaatgggagtgttatctaaggaaataattcaaataacctgtatactataccacccagataaataaattccaaatgatttatgatccacatgacaaataaaacttttgaactgttagaagaagagtaatcaaataaaatgtctttatgtttttggattacataaataatccttttttaaaaaagcagacattatggagaaaatagtgataaattataataaatatgcatcttaatgaattactttatataattaaaaatcaataaaatagttaaaggcaacagaacagatatctccagtgctcaactgtgtaagcttgggcaaattatttaatctccacatatctaattttcctcactgtgagatgatattagttacacatctcagaaggtagttatgaaaaatatatattcagagctgggcatagtggctttcacctgtaatgcagcaccttgggaggccgaggtggcagaatcacttgaggccaagagttcaagactagcctgagaaaaatagtgagatcctctctccacaagaaattaaaaacaaaaattaactgggtgcagtggcacacacctgtaggggtcccagctactcgggaggctgaggttggaaggatcactggagcccaggagctggaagctgcagtgagctaaaaatgctcttcaccctgtgtgacagagtaagagttcatctctaaaaaacaaacaaatgaaatgcaaattcattatgcataaagcccttagaacagtatgcagcactgatttgcactgttaaatgtttgcctttacatcctcaaaaagagaccatcatccatgaatgtaaagatttcctgcaaaccaataacagatgttcagccaatcaaaaattggcttgctattcaagaagggaatttagaatgatcaagacaacaaatacagaaatgcacatctgcactattttcaaggaacttgcaaattgaaatataaactgtcaatatattatactcatcaaagtgacaaatatattgtctgataataacaagtgttgggaataggataaggggtgcagaattttcttacctgctagtgagtgtatagcataatacaacttgtttggaaagaaatacaccaggatatactgaagataaaattagtactaccctatgtatcagttagctactgctgcataacaaagcactctaaaattcattcccttaaaacaataagcacttactactgcttatcagcctatgaatgttgttaattgtaaatttattttggtcttggctgtgctcattgatgtgtatttattgttgttttggggtgaactctctcaggtagttggggatttgcgggaggtaattttgcctaggttggggccaatgggttcttctttatggcatctattgtattccaatccactagtctgcatttttcagagagcagtggtagagtttcaagagattaagaatatgtacaggggatttcagttctagtcttggaaatagcatatcattatatttttttttcttttgaaaaaacacaatcataaaccagtcaagattcaaggggtgaaaatacagactttatctctatgtatgaggaatagcaaattcatgggacagattgtagaactggggaccccttttgcctgtcaatcgactacaccctgtaattcaacattatctatctagtagttatgtgccctagagctgaggtcttcaacctggcagaggcctttttaaaactttttcaaagtatgactcagctgattattttaaagaaaccaactttcaggtactcaacctccatatgttgtcttttctaagccttcctggtcaccaaaatctcttcccatatcacaaaaggatgaccttcagtacacaagatgcgttggtactgacctgccagggcttgtaataaaagaagtaaccatctgaatgctgctttctgggaagctactttactgaaagctccataaattaagcctcccagggaggtgtggtggctcatgcctgtaatccaagcactctgggaggctgccagaggtggatcgcctgaggtttggagtttagagaccagcctggccaacatggcgagaccccttctctactataaatacaaaaattaatttggcatgctggtgcattcctggaatcccagctactcgggaagctgaggcaggagaatcacttggacccaggaagtggagcttgcagtgagccgaaatcactcactgcactctagcctgggtgacaagagccgaactccatctaaaaaaaaaaaaaaaaagcctgccatcttatacgtatttctattggtcctgtaccaatgttcttatttcagaacatgaaaaaagaaaagaagccataagttatctaaggcaattcttccaaatccagaaatcgaactttcctgtcaaaaaccagtttttcaaagtgcacatacattgggtgaagcccatcggtaaatgatccaatctgaaaatcttctgaaagtcatctttcaatttcttggtggtagtactattcaagtggaggttcagatagatttcaaaatgtctgcatggaatattttccccagctagagtcttttctctcagtgtatggaggaaagaggaagtatccagattgagtacctgctcttctcatctttcttgggctactcttgtcccttctgtgccctccccttccaacctatgctttccctcagagcagcctgttttctttgctcccataaatgtattactggtccttgctcttctgtgcatatttagcagccctaaccctcttcctcaccagccacccttctatccccagactggcctaccagaaacagcagagtatcctcaattcgtgcatgcattttcctgccacgttggaatgatctgtatgcatgtctgtctctgatgttcatttcctttttcagcgtggctatgtatttacctcttttagccaggactgcatggcattacctctctaagccagtcaaaaggttcaatacatacttatagaaggaatgggcttatgagcaaataaactcatgtgtcatggtcagtctgtgaagacagatcagtcacctcctagctgcagagaactggggattgtaaattctcccccagttgcctttctgcgttggattacaagattaagcctgtattcctctgtggccaagtgataaaataatcaatcacacccacatctatcatggccaagaaaacatttatttcctcacctcctcccataggcaaattgccccgggaggagcaatatggaaaataatgtagttcactaaaaaagcctctttctctacttaagataacagtatcaagttgaaaattaaccttgacctcttaaaagaaaggaatatacagtaaaatatgaactactaaatacattttaatataatatctcatgaagagcaataatgctaaggttctttttggctatttccttatattcttgcttagataacaagatcacatttgtatctgatgactttctctgatgatttagatatgtaagtggcaataaaattaatatatattataaacagatttaaattatttcctgatgcataatgttaacagcagtagatgtgactgtgaggtttttcctttgatgttaattttgcttttacaatagtcctcattttccacatttttaaattttctttttgttataaggtctagctgtgtcacccaggctggagtgtaatcacacaatctcagttcactgcaatgaggttcaaatgattctcccatctcaatctcttgaatagctgggactacaggatgtaccaccatgtctggctaattttttgtgaattttgtagagacgagctttccccatgttggccagtcttgtctggaattactgagctccacctacctcaacttcccaaagtgttgggattaaggcatgagccaccatgtgcatatcattttccaaattatttacaaagtgtttctcttacattaataacataaagtactattttagaaagactgactttgaaaataacatagataaagcactaaatgtgaacatcagaagaacaggttaaaaaatgctggaatattcttcaggattagggaaattgagatttttttaataaaatgatatttaaatcttaataatagaatggctgtacttttgtttggagtatttaaatcttctcatttaaaaccagttctgcacagaagttttacagagatgctaattgttgtatgaaatggaatattattctggcattttgaggaagggtagacatagagaagagaaaggaaactcgcagtccacctaggttttatttgggcttctttgtgtgtgtgtgtgtccaagccacaagctgggtttattcttgaataaacattagccaaattgtttttcctgaaccgtctattacctgcatgtacatagaccatggttgtgttcaaactagataatcaagatgacttgttttgttttagagacatttagttagttgtaattacatggacaaataaagcagcagtttatcaaaaaagaaagaaaggattaaaaaattatgcataggaaaggcagtatgtaatttctgcctttctgtttctggggtgaggctgtgctaaataagattaatttaaaattgggatttggcaagtaatttctatcaaaatctcagcaggaggttttgttgcaactaacaagctgatgtggaaatttgcatggaaagtcaaaggacctagaacaagcaaaaagaccttggaataggggaagaaagttggagggctttcatttaccatatgcagaaacctgaaaccggaccctttccttacaccttacacaaaaattaactcaagatggattaaacacttaagacctaaaaccataaaaaccctagaagaaaacctaagcaataccatttaggacataggcatgggcaaacgcttcatgactagaacaccaaaagcattggcaacaaaagccaaaacagacaaatgggatcctattaaactaaagatcttctgcacagcaaaagaaactagcatcagagtgaacaggcaatctacagaatggaagaaaaagtttgcaacttatctaactgacaaaggactaataaccagaatctacaaagaacttaaacagatttacaagaaaaaaacaagctcatcaaaaagtgggtgaagtatatgaacagacacttctcaaaagaagacatttatgcagccaacaagcatatgaaataaagctcatcatcagtggtcattacagaaatgcaaatcaaaaccataatgagataccatcttatgccccgttagaatgacaatcattaaaaactcagaaaacaacagatgctggagaggatgtggagaaataggaatgcttttacactgttggtgggagtgtaaattagttctaccattgtggaagacagtgtggcaattcctcaaggatctggaactagaaataccatttgacctagaaatcccattgggtatttacccaagtctctttgggtatatactcaaatgattataaattattgtactataaagacatgactatgtatgtttattgtagcactattcacaatagcaacaactcgtaagcaacccaaatgcccatcaatgataaactggataacaaaatgtggtacatatctaccgcggaatactatgcagccataaaaaaggacgtcctttgcaggcacatggatgaagttggaaaccatcattctcagcaaactaacacaagaacagaaaaccaaacaccacatgttttcactcataagtgggagttgaacaggagaaaacatggacacagggaggggaaagtcacacacccgggcctgtcatggagtggaagggtaggagacggatggcattaggagaaattcctaatgtagatgccgggctgatgagtgcaggaaaccacaatggcacatgtatacctatgtaacaaacctgcacgttctgcacatgcacctcagaactgaaagtataatttttttttaaataaaggtactataaagctatagtaattgagatagtaggcaactcatttgggtataagtttggattaatgatatataattaattacagttggcccttgaacaacacaaggtttagaacccctgcacagtcgaatattcacttttaactttttactccctcaatacttaacaactaatagcctactgttgactggaatacttaccaataacataaacagctaattaacacatcttttgtatgttatatatacaatatgctgtattctccaaataaactaagttagagaaaagaaaatgatattaagaaaatcataaataagagaaaatgcatttaccactcattaaatagaagtggatctttttgaaagtcctcatcctcatcttcatatttagtaagctaaggaggaggaaggagagaagaggttggtctttctgtttcagggatgggtggtagagatggaagaaaaaggtagatctgcacagcacagttcagacctatgtagttcaacagtcaattataaacagtttagaaatcaatccttcaatttatagtcaacaagtttttttaaatgctgcgaaaacaattaaaggaggcaaggatagtcttctcaataaatggcactgagacaattggttattcatatgtaaaaagatggatttcaacccttaacacttattatacccaaaaatttactcaaaatgaatgacagatgaaaatgtaagaattaaaattcttaaacttttaggaaacatcaacaacacaggacaatgtcttcagggccatggattgggaaagatttcataaatgtgacttcaaaaatacagtagttaaaagaattgatcagttgaacctcaaaaggacaatcctttaatgaaaagtattgatcagtttaaagtcatcaaaatgaaaaacttttgcattttgaaagttatcactgagaaaaccaaaagacaagccataaactgggagaggagattggctaactatattcctgataaaagatttttatctccaaaatgtgtaaaacaaaacaaaacactattcagtaataagacacaaattattttttaattggcaaaaatatattattagacgtttcaccaaagagagtatacatgagaagatacttaatatcattagttattagacattagctacattaaaactacaatgaggtcaggtgtggtggcttatgcctgtaattccagcacattgggacgccaaaatgagtggattgtttgaggccaggagtttcacaccatcccggacaatagggaaagatcccatgtctaccaaaatacaaaaattaaccaggggcggccgggcgctgtggctcacgcctgtaatcccagcactttgggaggccgaggcgggcggatcacgaggtcaggagatagagaccatcctggctaatacggtgaaaccccgtctctactaaaaatacaaaaaaattagccggtcatggtggagggcacctgtagtcccagctactctggaggctgaggcaggagaatggcgtgaactcaggaggcggagctggcagtgagtagagatctcgccactgcactccagactgggcgacagagcgagactccctatggaaaaaaaaaattagccagaagtagtggtgaaggcctggagtcccagctacttgagaggctgaggcacgagaattgcttaaacccatgaggtggatggaggttgtagtgagccgagatcacaccactgcccaccagtctggctaacaaagtgagactctatctcaaaaaataaaaacaaacaaacaaaaaaaccctacagtgagacacaattttacacccattagtatggctataacaacaacaacaaaaaagatattagcaagtgttgtctaggtaatagaaaaaatagagaccctttatatcaccattggtgagaatgccaactattacagctaatttggaaaataatcggccaatttcttaaaacaaaaacattaaacataaatttgccttatgaaacagcaatttcagccctagatatgtatgcaaagagatgaaaatatatgtccatgcaaaaaatggtacacaggtacacaaataattgttcatagcagcattattaataataatcaacaagtagaaatagaccaaatgtcactaaaaaataaatggatttaaaagatgtggtatacccatacaatggaaaataatttagccctaaaaaagtattgatgcatggtacaatatggacggacattgaaaatattatgtaaagtaaaagaagccagacacaaaagactacatattatatgagttcatttatatgaaatgcctagaaaaagacaaatcttacaaagacagaaagtggatcagcaaggctgtcactcccacgcactcagccaggtctgattttaaaggatattaagccccattaaatggaaattaagttttgtttgatgtatggaaacagcaatatcaagtcttggtttcaaaatatgtttaacctcttttgagttatgtagaactggaaaatgtttttcactcgcaagtattggacataacagtatttcccctctgccttaatccacttatcctagaaccctataggaaggcaaagactgttttaattgagcgacacagttaaagttattgatagtggggtatgcacacatgggctacatctgtctatgaaaaggaaacaatggagccaattttttaagtaattcaagcaaaattaaatgttcacaccttttaaatctggaagctataaaaagcaaaatggtgctctgtacacaaagagcatagcctagtttttgctatccttaagcctcttcctgcattttgcctatattaaatttcctatgcagatattattgaggtgatcaggtaggtgacttcaatttttattttctataacaaattcaaattcaataactttcaagtaatatttaataactattttaaacacagaagacatagtctataatattttgtcctgacttaaatacttattgcaagtagtagatgttaatacaagaaaacaatactgaataatgggtagttgttctttaaacatggagtagaggtaaatcttagtgatttagggacatttctaatttttagagattgtgcaattttaagtttctaatgcatgcaattaatgtcaattttctgatattttgattaaagtcctcccatgtttgctgtatgtgcttttgcttgccttatgaaaatttctaaccatagtgtatcagtaacatttcaaaaatgtatttaaattataatatgttcaaatcaaagtactgtcaaatatgccatatgcatttcttttaagaatgtgggaaatacctttaataattttattttctctttttttaaaactcacattagcatttttttgcagtagcatcattttaacccccaactgcatatccacagtatagctaatattttttacaagtaacattttgaatttgttcttcttgacatctttatgtttatatgcattttgcatttccctatctcatttttttgaaaccaaatgtaaccaatttcaagtttttgtgttacattcattttttttcttttactaggtagcatctttctcttttctgaattttttgcaaacatattgtttctgaattctctttcatccctttattttccttttcaatatcaccccaggaaccaacataaagagaaatgcagacgatataaccagtaatgaccatggtgaagataaaggtattttttgttttttcaaagctcaaccctgatgcatgattttatgtctatctatctctctcttttttttatttcaacctgtttttcctccccttatttaactcttgtacacttttgtgtgcttctttattttcttcttgtatagaaaccactgttatttttaaccccagttaccatgtactggaaacaaatcactgtgtgaagtataaacattgtttctgtacatgaaaatagtaatgaaatactacttacagagaagcccaccttttttttttttctttttttggctttgtcacaagaagaaaaaatagaattttaaagaatgcatgtatagtctcttttatcccttccaaatgttattttgtaagttaatatactactttgcagcttcagtcttcctaattagttttgcaaactgcaaaactttgcagcaccttagaataattttttcataggactgaagtttcaattttgtttctttggtttggcattctttacaaacatattgattccaacatagtcatccaataatctgcttacagtgaagtacatcaaaaagcattttaacaagatgctgttgttaacaagccctgattctttcagtactgccttttacaacatttaaagaaaaaaataagaagtagctcagaactgaaaaaggacaaaaagctagctatgtgcatctttgttttcacaccaccgttctttgaaaatatgtttctcctttaaatgttttattgctgtgaagtttctttttaaggtgacaaaattgctcaatagattatctaccagtagtggaaatatttttcataaaggtggaaggtctgagcagtcatgcagaaaacatagacactatttttatcccctttgtgtagaagaaatttgtttttgtttttgttcttgtttttttaaaagaggagaaacaacaagaaagtactcaagccattcctcattggtaaggctctatatgattagctaactgcacattttttcccatctgggtagcaaaatgtatggaattctatttatttttcataaacaataaggccctggctggacctttgggtctctgtctgaaaggccaagcccaaaagtgagtgttgcattatccttgctggtcaagccccattttcttgaaagtgtcttttgaccagttcttgtagttgctcccctccttgcttatcttcataaatcaactgttctccaagaaaagaagtcttgccaacactcttttcatgcctggtcttcccttaacattttgattattactgagcacatagggttgtcactgcctcaagtagctctctaagaggtcttgattctgatggtggtagaagttcaggtacctcttctttgataagggcttctaaatgcctcacattttgtcagtattgagcaaatacataaaaatgaaataaacttttgttctctcataccttatactgctctaatttgtatcctctttggtgtcctctcacatacttccttttgataattaagatctgttttcacattattcccagtgaatgtttattaccatgaaaatgccatctaattttctcttaatattaataagctgtgattttttgaatttgctttaatgtaacaactggtatcactccacaagttcaagagaatcttgttgtatgttttatgaaaggtaagaaatgttaatttcccatattttcaaagggagcactttaaagcagcccttcaaaatctctacttactctttttaccacaatttactagccaacagctggtagtggtaaaagaaatgaagccaaaaacaggaaattaggaaccgggaagaagaagtggaacatgagaaaagccatttcttattcatatagcagaggacatttcccatagagtatgatgaataagtgatgaatgaagatttttactttatatttgaattttatatgagaaaataaaagacacttttctgccgtggattaaatatctgcaaataaatactcgggtaacttgacattcttttgtgtgctttactgtgaccattgggtatgtcatgtcatctgtatgcaccctgtaaaattgtgatcataattcattcaaattggagccaccatccaaacgatggtaattcatatcctcagaattcctttctcatatttcaagtgtccctgtgaattatgaggggaaaaaaatctttattaaagaaaaaagtgaaaataaatatgcatggatacttggatttttcttttagtaacaaagatatttaaattatttgtatacacacacacacacacacacacacacacacacacgtatctgtacctagaaatgtttataggggaggtcagttttctgaagattaaatgcagccctaatgtcagattaatgttataaacacatcgtttaatcacaagttttcagagagcaggctccacagatagtctctaactttctatcattacaaatcgctatttttatatcattgctaatttaaataataaagtaaattatgaagaggaatcattggttgcaagtcaccatgggagtttagtccctgtgaaaatataaagcatttaaataatttgtattcttttaccattttttattacatctctttaatttttgtcacttgaatatattaggatgatgatgatactataatcactggaacaaagacatttgcttggacatcttttcttttttcccccatttttgttctgttaataatttttaactatagcttttcctttcttgtccttatctgtcccttatcgatcatagatagtttcactactatttttaagtttttattgttaaattgaagatgaatctgtacagttacttgtgaattaagatgcagctaagttaaaatcaagtataattttgaagctgattttacatttaactagatgattaaatatattttttcaggtgcttcttcaatttaaatcaagttttatggtttcagcaaaatttagaaaatatgtactttacctaaaaacttttcttttagtgctttggatatatacagaagcttaaatgagtagagtatcccaaacatccagatgcttctcaaaatagcatttccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatagcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaatagcatttccagaaacagaaaatgtaatagcattagtcaagttacttagaaactcttatcaagtgtcatatcatccataaaaattaatttgcttacttcaagtcaaaataaggaaatcagggaatctcctttgttcttaatttagcatcagtgagtgagccagtaagattctttactgcgtttccttacttggctttttttccagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactaggtaagtgatttcatcatgtgaatgactaagcaagaggaaacatgaaagttccacttcttattttgatgggactcatggatttgaatcccgttattacagttcctggttaattccactttacggtatttactttatgttatcaggtatgttttttccttttattaccttcatgcaacatgaccatcttattgttttattatcattcttttcctttcgcttctgatccaaaaatttttttcttgtggaagttgaatcccttctcaaacaaatggccacttcaagttcatcaggattaaatgaaattttatttaaagcatgtttcttcattggaattaaatgaatgtgtatttatctacataagtgtgtataatgagcacatatttggtgatatgataattagtaatggccatagatcttagctttctagtctgattgtgttactatatgaattagtatattgtatggaggaaaagattttatccagttccctaactgattatgttgaggctttggaagatctgctgtttaggttctgttagttgacttttttttttcatttgataatctacaattaaaggccaagtacatggaaattcaagtttagctcctccttgtttagatgtttcattcattgtcttctaattgtgggttggaaaattaagttacaacttcagggtaaaggttttaataccttcttagatgacctttcctgcttttggttagttcgtgaataatattcctagatctctgtaaaaacatttgtttttttgggtaaaaatccattaaaatgatgtagaaaataaaattttaacaaattattcaattcactacatgtaggttagcttgaatgaagttatatttgttgcatgcatttgatcttgaattgaaacctacagtttaagaaaatctgcatgtctttatatttttaacagactgtcagagttataaaagcaaaacattagagctttacagtataatattttttctttagatctttcatgggcatttaaaatcactcattatgaagagaccataaaccatgggtttctaagaggtgtgctgaattttgcaactggctggtgtgttttctaaataatcctgtaatcttcatgtattagtttttttttttcataacaaatcatgacaaatgttctctttaaacaagaggaatttactttctcataatttgggaaaccagatgttcaaaacaaaggtgttggcagggctgtctttccctaggtagctccagaacaagattctttcttgccttttcagcttctggtggccctggtgtttgtttctatcttcacaacactgtcttccctgtattttatgtgtcatctccttttcttttcctttcttttcttttctcttttttttgggggaggtagggggacagaatctctgtcacccaggctggagtgcagtgacatgatcttggctcactgcaacctctgcctcccaggttcaagcaattctctggcctcagccttctaagtagctgggattacaggcacccacgaccatgcccagctaacttttatatttttttagtagtcatggggtttcaccatggtggccaggctggtttcgaattcctgacctcaggtaatccacccctgtcggccacccaaagtactaggattacaggtgttggcgaccttgccaggcctcctttccttgtaaggataccagtcattggatttagggtttatcctaaattcaggataattatatctgaagacccttaactaattacatctgcaaagaccctgtcttcaaatagatcacattcatagtttccaggtagaaatatatttttggaggatattgctcaacccactccacccaatcgatgattattgcaatatgtatgtgtgaatataggtgctttcagatgcttccattccatatgtgtgcacaaccactgtgttcagaattccaccttgctttctacttactaggccacactctggtaagatgatctgaggacagtctggaattcttcttccctttgtattcaaataatatagtcatgcagtatctaaaagtttattccctgagcctttaaaacttctccatcagtttgacaaggagtaaaagtgtttttccccatttgtcacaaaacttgtgcaaaaagcacctttcccatgggccaatacacagagctatatttcacattttcttcttaaattacagggttataaatataaaacaaaacctttaccttgctgtattatttccaacttttccctctattattaattccgattacaaatgctcattaatgttctaccttggaattgcaatttgggcatgtgccatctgaaaatggaggttcctaaaaattaatatcaaagattaatgcaagttttaaaaaagggacttattcaaacataactcccattttaacgtgactcgtggacttttaatgaaatgaatggccttgtaatgcctaattttttttcttaaaatcaactgtgtcatagccttctctttagaacatatctgatttgccagaacccaagatttgtgagatggtgttattttttatttttactctttccccaccccatagtaccatgaagagattatgtaacatccttttctggttttaaagacaggtgaataatgattatgtaacatgcaaacaagttgggtgttttagagaaggtggtgttaatggtgtctgattcacagatgctggcttgaaccttactggtgttaggacctatattctggtaagatccaactttaggccatggattacaggacctaggtgtataaaaacgatacctaaaacccataagatcttagttcactgatcagcaggagagatagttttctttcaaatgataccatcagatgcatctccagcagactgttaagtcagtgaaaagaaaaatgccatcatagagaagttcttcagacttttaaaaatttcctaggattatgccagtgattcctactacagagacaaagatatatgtatttctgaatttgagatgttggatattggtagagattcatcttttgaatgcaaataaatatgctttacttttagccagcatgaatgctctcatttgccacaggttggccagcttaagtatgaagggtgttgtgggtaaccttaacagaaggtttttatagtaccaaaatttctttctttttttattatcctatttcagaaagtttcttaactctgagatactttatattggggataatagttctggtgcaagtatagattaatagattattaaacacttcaacatatagatggaagagtacaaatagtatattattactgattcccatttactctttctttaatttacactggaatttttgtttatgctaacttttgaagataccaatgataggaagttaatagtgcttgccttttataatttttccagagcttattcatttgaagttcaaatttggaaactttccttttgttctttgggaaacagatattattgctattcaaaatgggtaatctctaaattgatatagaaaaagatatttgaggctggatgcagtggctcatatctgttatcttagcacattggaaagctaaggcaggaggacaacttgaagccaggagtttgagaccagcctagacaatatgacaaaactccatctctgctaagaatacaaaaattagctgggcatggtgtcacacacctgtaatcccagctacctgggaggctgagatgcacgaatcagtggagcctgggagttggagtgtgcagtgaccacctcactccaccctgggctacagagcaagactgtgtttccaaaaaaagaaaagaaagaaagaaagaaagaaaaagaaatttgagatattagtattgtccaaaaagtataattcaaatacttaatgcagaaggtagtagcatcattaacttactgacccattcatcaattataacagagggaaggttctatgttagtgtcttggaggctgattgagctaggggatacaattttaagtatgagtttcatagaacagattcaggaggtctaaatagaggggtctacaattaggaagcacccttaatcccacccctgaattactgacagcaacactaactaggcagcagagagatatttcctgatctcagcagtcaagacaatggtactaaaggttgctagataaatgtgatttttgtagtcactcacctgcaagttataggcaagataatatttacctgcactcccaccagaaattagacctaattgactgctcttaatcagaacaagacattccaacctcttattcatggttagcaatatatcccacttgcttcactttgtgattcatcattgcatgggtataactggacatggaatgcatttgaaactgagcctcaagttcaaatcaccatagaacctaaaaagaaaatgtaggagagacaaaacagaagaaaaatgccaaacagagagttattatttagatgtgttcattctgtgaacagagagcagtttctattggatctggctgaaataggggcccctggtgtcgtgaaagtggtgtatgtcttcatacatgttcccatgggcctatacaaccaatctcatttgacaaatgaagaaatgaaggcttgtggtcagggtcacaaaacttgacagtggcagaagtggatccaatttccagtcaaatctatgactcaatccatcttcgccacaatcatagtgcaaatcagttgctctgtttccgatcagtacccacacaccagaaggtcagctctttaagggcatgaattgttgttgtttggttcattgttgagtgtttggagcttggaccagtacatcgaaagtcttaattgttgacattctcagtaatgcaaaataaattgtattcttggatcattggcatcatatccattaggatggctgttaataaagtaaatgtaaaataagaagttgtgatggagatgtggaggaactggaactctttcacattgctggtgggaatgtaaaatggtacagtcattgtggaaaactctttgtctgttcctcaaaaaagtaaacatggaactaccatatgtgatccaacaattctacctccgggtatatactcaaaagagttgaaagcaggtattccaagagatatttgtatgcccaaattcttagccatgttttctcaatagctaacaggtgaacttttgaaatagccactgcccagtgatggatgaatggataaaaattgatgtatatgtatatatgtatgtgtgtgtgcacaaatacaaacacatacactactgaaatggaatgttattcatctgtaaaaaggaaggaaattctgatacatgctacaatataaataaaccttgaatacatcattctaagagaaataagctataagctagtcacaaaaggacaaatgctgtattattttaccaatatggggttccacctagagttgtcaaattcatagagacaaaaagttgtatggtgtttgtgtggggctgggagacaaaatggaaaattattttctaatggatagaatttcaattttgaaaggtataaaatcatttggagatggatggtggggacagttggacaataatgtgactattcttaaggccactcaattatacaccaaaaaatagctaaaatgataaaatttcatattatctatattgtatcacaacaaaagaaatcattatgatatctgtgatttaattgactcattgtaatcattaccatgttaggtcatgttcagtatctcatatccagcaatattgcaatggacatggtaatttttgagtggtagaaactcacgtaacttttaaaaacacatctgtgtgtattcacatattcttatatttcttggaattgaaatcatactctctatatctcatttatttctcgtagcaaaatgtttacaaggttttcaagattcatccacattgtagcatgtatcagtcagtaccgcatactggtttatggctggatactgttccattttatgatagaccacattctattatatatctgtttttcatttgatggacatttgggttcaattcatacagaaagaaagtagactagtggttactggttctgggatgagaaccatagggaattagcatgtcatggttacagagtttccatttgtgaagaagaaagagttctagagatagattcataaaaatgtgaattactgaatggcgtcaaacagaacagtacactttaaaatggttcacattatgttatgtgaatttcatcttaaatagaagaagaatacagtctgaagttgtcatgtacttcactaggatgatctctttaaaagggtaggaaagaaattagtgttcatccatgtcctcaaaagagcatataaacaaactaaacaaccatcaaataaaacatgtcaatgtacctcacagcatcccaaaagggaagactaaactaaactgttctcagggctccttcttccttatgtgttactttcagaggcactttagcttaggacttaatttgactattcacaaccccagggtgtccatttgatctcacagcaaacttgagttgactttgaccagggaaacactttactttaagaaactgtagaaaggagaaaattttatacgtatccagtttctatccatttcattgcacatatggtgagaacttaagtgttgtaagcatgccacttgcagggccctgggctcacagctacaagctatattttgtatttgcatccactgttttgttagcagatgtatatacttgctgacaaaatacatgttttaagaaataaaattattttaagaacaaaataataatatgttttaagaaaacatgcttgtatttaccttttatttttcataaaaaaaaatgtttatgggcagggcacggtggcttatgcctgtaatcccagcactttggaagccctaggcaggtggatcaggatgtcaagagtttgagaccagcctggccaatatggtaaaaccccatgtctactaaaattacaaaaattagccaagcatggtggcgcacacctgtagtcccagatacttgggaggctgaggcaggagaatcacttgaagccagaaggcaaaggttgcagtgagccaagatcacgctactacactctgacctaggtgtcagaataagactccatctaaaaaaaaagtttatgaatttatggatgttagaaactcagttttgttacatgggtttattcatagtggtgatctctgggcttatattgcacccgtcacctgaatagtggaacctgtatccagtaggtattatttcatcattcattctccttccatgtcctcatattttgtagcctccagtgtctattccactctgtattccactattccactctgtatgttaatgtgtacctgttgtttagctcccacttataagtgagaatatgcagtattgaactttctgagttatttcactcatgatactgagttccacccagtttcacccatgtccctgcaaaacacataatttcattcttttttatgactgactactgagttgtattccatggatatataaactacggtatatataatttatgtatccagttatctagtcatttgttatggacacttaagttgatttcatgactttactattgtgaatagtgcagtgataaacatatcagtacaggtctctttttaatagaacaatttcttttcctttgggcagaaacccactactgggattgctgaaccaaattatgtgtgtgtgtgtgtgtgtgtgtgtgtgtgtgtgtgtgtgtgtgtatagttcttgtttgtttttttgagacagagtctgactctgtcaccaggctggagtgcagtggcatgatattgactcagtataaatttcatctcccaggttcaagtgattcttctgcctcagcctcctgagtagctgggattacagacctgcaccaccacccccagataatttttgtatttttagtaggaacagggtttcaccatgttggccaggattgtctcgatctcttgaccttgtgatctgcttgccttggcctcccaaagtgctgggattacaggcgtgagccactacgcctggccccaaatggtagttctatcttaagttatttggaaaatctccatactgcattccatagaggttgtattaatttaccttctcaccaacagtgtataactgtacccttttctcaccattcttgccaacgtatgttgctttttgacgtttttcaaaatgtcattcatttccacattttattataattccttaaaattatgacttttaacaaagagaagggaaacatacagttggtaatttttttaagtgctgtataatttctagttagaaagccacagataagccccgtgctgaagcgaggtggtaaaatagcacaagtttgaaataaagtaaatttgggaagataaagttgtttttaggatgataaagatgttagatgtttaaacttggtccaatttttctaacttttactgtattcttcacacttacccaaaccacaaacaacaaaagtgagataaggcagtgattggggatcctgttccaatgcagataccagagattctcttactggaatgatgaatggttaacagctatgctgcatgtggaagtaaaatgctttcccccccaaaaaaaatggaccaataaacacatagcttgggcctttaaggtcatatcaaccaatggttgacccaaagtctgtccaggtgtgttgacagacttcagtctttcttcctgtgatatgagttcaggtagtagaaactcagggaagggccctttgctttcttttttgatgggtccagactttagcagataagcaacattagagaaaaacttcctcctgtgctttggggtcacagagggttgaaagacaagagggagtgagagaagatgagagacattgaggcttcttcttcagttcaacacatcaaagcaccatatgttggagcatggatttctgagtcccaacaactgggtagtgaagaccacccagggctgtgtgttgaggattctgatgcagacagtcaaggctcacttctctgagaggaagctaaatgcgactcaggaacacatccccatctcaaatgtgtttgttatattgatgacagttggcactcagatagcatgcatcccttgtggtttcaacggttggttgacatgaccttaaaggccaaagctatgtattcattggtccatttttttgaggaatgcattttatttccacaatgcagcaaagctgctaaccattcatcatgccagtaagagaatccccgggatctgcactggaacaggatccccaatcactgctttatctcacttttgttgtttgttttgttttaatttgttttatgttttacaaataatctgaagttaaaatataattgataaaagcagttatcttgtgatgtcaggataagtaaactagtgcacttcaagcaacatctaaccaagtgtcattttcttgctggattgcaatattgataggcacatgggataatatatcacgtagatcctgattgtagatcaatgcatcttgatcctgcatcttgaccctcttctcagtgggctacatttatgcctaaagaaaaatattctctcaatcctcaagaacatgaaacattacaatctgcagagcaaattgccagcaggagaaaatgttaccaaatattcaaaagcatgctttttgtgtaaatgatcttgaaactccaggtaatgggggaaacagggtgaggagtgcataagccaagaaccttatttgacccagcagcttccggtttctaaaaccctactcatgcagtgccaggaggaaaataaccaattggcatcacttaatgtttagtgatagaaaaagaaaagcatgcctttgttcattttctactcttctcatttcctgcctcaccattcatcaaatgaaacagtacattttcattttctctatatgacttgtagcatttttgggaatagatgatgcgcttaacatattgctgttcatttatgtgaaaagatatttctgctattgtccaaagagagtgtccatttgcaaaatatctagtgtatgaagacaagttttattttcatttttcccttgtctttatattttaaatgtagttataaaatgagagaacatgggttcacaaagaaacatgaaattcataattaataaatgtgattttctatttgttttaggtatgcaagaggcacgtttgtgtgggagctcaaaaatgtttaattattttaaatctcctttcactaatttaataaattttttttgagttcagatgcaatctattacacatgtttcttgattttagggcgattctaccccaacatgcaaaataaacaagagatccttctagttctttacaagtttcttagtgaaacacggcacttccctgatgctttcatgggtgggaactggagtgcacaggtgctggaacttgctggccacttcggggcaggcagtggcaatctccattgactcactgctccacccctcacaggaggagaagcacatgtgagagggtgcaggagccaagatgagcaattttggatgccagcaattttaggtgtaaggaagaaggaactccatatcacccccacagcagcatctcatagagggtgtttgctaccctggaagccccagaggaagtactacagtgtccctttatctttgccatctgcagacagcatgttaacagctcagtggtgggtgggtgtgacagccttttacacccacactcatggcacctaagttcttgtccagcctccaggaacaatgaagtcacacaaacaaattgaaatggtaaatgtgggggattttattgccagtagaattgctctcagggggaagggaagctgggatagagcagaaagttaaccttccctagaaatccagtcattcatggtcaaaatcctctccaaagctgcaccatcacgatgtacttctgaagtcaagccacttctctctgatgtccaaccattgtctctaatgtccagttggtatttccctctgctgtttatgcctagagtttttatgggcaccaaatgaggggcagggagggccatgggtggttttggaaaaggcaacattcaagtaagaagacaggaatgtaagttctcactttgggctgtggttgcatgctttttggcttgagggtggagccctctccaggtacccactctcttctgcccataatttccctgcctctgtccctatcaattttatatttattttaggtatgcaagaggcacatttttgtggaagtttgaaaatgtttaattattttaaatctccttttgttcatttaaggaatgtctttggagctcagatgtcattacacatgtttcctgactttggggagcttccttgctaacatgggaaataaacagagtccctagtaattatttccaagtttcttaggtaaccaattatatgtattctacaccccttagcagtgagtgttcatgttgtcaaatttccacttgttcttaaatgagattaaaacacaacaacaacgatgtttaaaagtttcaactataagaatataaaatcaatgtatactcctttgggtttttctctaattttttcacagaattctggtttgcaaaaagccagtagctgatttatcttctgaagatctctgtctaaaattaataggtatactttcataagcacacttcattttgcaggtgaaaaattttctcccaacaattgtatatgatagtgatttacaagtcagtatttttgctgtaaagagcgtgcctctaagtatcatgtgaagtaatttaaattatgccattttttagtaagcatgttgactgaatctcatgtatttccactgattccacactaaacaaactatgttttatttttactgcatttgacttggtttatatagtttacatagacacttttgtatgtctaagcatgcctgagcattatactacatggcatggtaatgtggtttggctgtgtcgctactcagatctcatcttgaattgcacttcccataatccccacatgtcatgggacagacacaatgggaggtaatcgagtcttgtgggtggctatcttcatgctgctctcaaaatagtgagttcttatgatatctgatagttgtataaggggctttttccccttttgctcaacatttttgttgctaccaccatttgaaaaacacgtttgcttccccttcttccatgattgcaagttccctgaggactccccagccatgctgaactgtgagtcaattaaacctttttacttcataaattacccagtcttgagtatgtctttattagcagtgtgagaacggactaaatacagtaaattagttctgagagtggggtgctgctgtaaagatacctgaaaatgtggaagtgactttggaactgggttaaacaggcagaggttgtaacagtttggaaggctcagaaaggaagatatgggaaagtttggaacttcctagacacttgttgaatgacgttgaccaaaatgctaatagtgatacggaccatgaagtccaagctaaggtggtctctgatggagaagagaagcttgttgggaactggaataaaagtgactcttgctatgtttaaggaaagagactggcagcattttgcccctgccctagaaatctgtggaattttgaacttgagagagatgatttatagtatctggtggaaggggaatttggggttagaacccacatacagagtctccactgggacactgcctagtggagctgtgaaaagaggggcatactccagacaccagagtggaagattgcaccaagcacctggaaaagccacagagggtcaatgccagctattgaaagcagctggtgttgaagggtgtatgcagcaaagccacaggtgtggagcttcctaaagccatgggagcccaacttttgcattattgtaacttggatgtgagacatggagtcaaagaagattattttagagctttacaatttggctgccccacaggattttagacctggatgggacctgtagccccttcatttttgtgaatttctcacatttggaacaagtgttttttagccaatgcctctactcccattgtgtttggaagtaactaacttgcttttgattttacaggctcataggcagaaagcacttgtcttgccacaggtgagactttggacttggacttttgagttaatgctgaatgagttaagactttgggggactgttggtatgatatgatttgtgttttgaagtgtgaggacatgagatttgggagggtctagggaccgaaagatatggtttggctgtgtctgcatccaaatctcatcttgaattatagtttccctaatctccttatgttgcgggagggacccagtgggaggtaattggatcttgggggcagataccctcattctgttctcatcatagtgagttttcatgagatctgatggtttcagaaggggcttttctcccatttgctctgcccttctccacgctgctgccatgtgaagaaggacatttttgcttcaccttctgccacaattaagtttccagaggcctctccagccctgtggaactgtgggttaattaaatgttttttctctataaattacccagtcttgggtatgtctttattagcaacatgagaatggactaatatccatggcacacagaaatctttctggggagaaaatcatggtctacaatattttcttactcagaaataaggggattctttgggaaatcatcttccagataaaatcatagcaagctgtggcaggagatttctgaagatcaaacatccttgtatgtgtctataaatattatctgagtcagcactcacaatctgataaatgccctatgtgttccagttttcaaatggtaggttttgagacagaattcacatgtcagatgagtcacataaatttgcagaatgtctgtgaaggggcatggatatctttggttagtaactacccaaccattttccaaagtggacttgatctttggtattagaattgagaagtccacctgacctaaagagaataaggtatcatcaggaagaaacaatataaaacaaatttttttactgttccattagccaaaggcagatgatgtcttagagatgtttggttacatagaggagaatcaaattaaaacacacaaaacaaagctatcctcctattaatatgatttactgtataggacacactaatttacttggtgagaaaagaaaatggtttaggggtacaaaatgcagttagatagaaggaataaattatatgattggataatgtggtaggaaaatgtatatttcaaaatagctggaagagaagaattggaatattcctaacccaaagaaaaaataaatatttgagatgatgaatatcccagttactctgattggatcattacacattgtttacaggggtgaacatattacatttgcctctaaaatatgttcaaatgtattatattgataataaataagtaaataaatggcaaaaaacagcatttccaaaagagtatatttctattaataactttttaaagggaaagagtccgatgaattgcaataaggttaaaagacagaaagatcctgtctctaaaaaaaaataataaaaataaaaatacataaatacattgccaaaaggttaaagaagtaaaaaccttctacacatccataactatagcaccattcttgctgtggtaactatggttttctctaggcttaaatattttaattatattttatattgatacttgctaataatataatatgtattgtatagatgacagactggcctttttgtgatggcttttgcttgcttggcgtatggtaaaattatttatgaaactttaggaaaaaggtttttatattttcttttttctttagtattgtggagtacagttcaaactaactaggaaaattaaagacctaagatattttataattatattaatatcatgagtaattacaaaaataacaataatgactttcactctgttttccagtcctgttcaagatatttacatgcaatgtccaattcaattcacaaaagcaataaaaagagacgctatttttttttccatttgtcaaacagtaaagctaaggttacagtctttcttattgataacctggtggtgatcttttgggatatcattggaatcccattggtttttctccagaggtacctgccattaagacttgttgcctcagtggttgatattggccaagacttcttaagtaaaaaattatttaatgttaggacttctgcctcacttttctaattagtggagcattttgcctctctacagaagagaatcccggaaaatgcaagagctgtctggtgttgcttagtgttcctgataatctagtattttcagtaacgttaactcatatccgcagggctatggagggggtcacatatttttattcaattaaatgtcaacacttgagaaaaactttgactgtcagaaaaaaactgagtgagatactcagcaaattgtttaacagttggggagtttgcaatagtctatgaaaactgttttactttatagagccagagaaatttttcattgaccctagcacagtgttggtttcactcagggatgctaactttgctaatatatttatccatatactgatataataattataatatcatgcttgtcactcactttgtaacaaccaaccacattgtcagaaataacatttgttatcccatctccctcctacaaaaatcctatgagatcctaatattatcttgattttctttaaacaaataccaccagaggccccctcttcttgaattaagttgggtttattgactcttatgtatttctattagtattattattattcattacagataggatcttgctgcgttgcccactctggtgtgcagctgtgtgatcataactcattacagcctccaactcctgggctcaaacaatcctcccacctcagcctcttgaatagctgggactacagttgcctgccaccacgtttggctaatttttatttatttttttttacaggtgtgatctcattatgttgtccaggctggtcttgaattcatgaccccagatgttcttcccacttctattgactctttacaacaagaaagaatatgtacataggggatgtctcagtacaagggtaggaaagagttagagaattggggcttgttttaaatgatttacagagggttctggaaaactgtgcttgaatttggaattgatactttcaggacgtgttggcagttctatgactggttatcttaatcttatgtaagaggaggaaaaatgaagcataggttaaagcaatggttgacaaagaaacaacagtcactgatgataccaaggacaggtggacacttgatcatgtttgagtgtttgaataaccacttttttgtgtaagtgtccagacatgattacaatgtggtcttcattttgtcttgttctttcatgatcacacagtggtttttccttctgtcactgttccattattattattattattactattatttatattcaatagaacaatggcacaacctagctgcaagggacaggaaaacacccaggattgccagggtttaggtgacattgccaggtcagctgctgatcaccagggattgcttttctcttttgtgagtaactgaatattaaataaaccgagtaacatatcccaaatcctaccgagagttggaggtaatactggagtctcaacaaagactatagaggagagtctagcccattcatctccaggcttttctctaggaaaccaaagaccaatattatatttgttgcagaaaagagacaccctatagtcaacataatgtccagtgagagttaattttaatgaggttctttttcagaattcaagaaagctggagaaaagaggcgttgtgtaactcacataccaggaggcatcttctgtagctagtcagcagatgcctcttccactggagggatgcgatcttaaggataggagaattccatttataaccaagaccgcttcattcatgggcctggattggatagggatggcccataccaaggtctttgattctcgcttttattgttacattctgtatgactgattcagatttgtccgcactaatatattttctctggttctgatcattgtggccatgtcttcctagaacaaaggccttgggttaatttttgcagagtaatgacgttctcagcagcagctgaactctgtagatcaatattcctctttcttgttttcttccaatggcaactaaacatgcaagacacatcaggagaagggtatgagattccccaatagctaaccagcaataataatgcaacatgtaaggctaatgcatgcccttgaaatgccaagggataaattcatatgcattttttcatttggggtttgaagagccagatgacatgcaaaagaaaaatattgacaaaagatatcttatcatttattttcaattattaagcttgattttcatacattcaaacttagttttttaacaggtacatgactctagtttttgaaagccagaagaatgcacatataaaatcttttttgtctaacaaattaatcccatgtttcttggttctgatgcttgcatactgcttatgttaaaacaattgtgagcaagcccaaactatacttttttttttgagatggagtctcactgtgttgtccaggctggagtgcagtggcgcgatctcagctcattgcaagctctgcctcccagtctcacactattctcctacctcagcctctggagtagctatattatacttatttttaaaatgacagtacggctgaggtattcaaaatatgtttaaaggttctaacagaaacatgttagaaaaaaagaagcttgacagcttttaagtttattagatacagaaatttatacttagatttatttagattgaaaattaatcctaaggcatttaaccagctgggagagcttatgcatgcatacgagtttcaagctgcaactaaggcagttgggcagcagtagaaacaaaaagttgatatttattttctttcagaaccaactgtgactgattaaccacaaaagatcagcaggggtatttgggcctaggtcatgttgatggccttttgggttttagtttgctttagggttcattgctgcaaaaggaagcctcctctacaaatgagatgagactgcatgagtacaaagcagagagatgcagtgctttctacagcactgagtaggcaaattgtgcagatttttcagtagaatctacttaacaccaatccatgcatttgcattttattaaaatgaaactatgataatttaaactgcacattgcagatatgacctataaaatgtttgatgtcctatttttaacaaaagttttgaaaatttgcactccatatcaatttctctacttatgtgttttagttattttttgtaaagaatgccagattttcaaagcaagtaggccaagaggatgatctttttttcctccttttttttcccccgatgtttaaaatgcaactgccatggggctgtgcccttttagctgttggaaaaaataatctactatgccttggttgtatgtgtgagtcaccagaccttctgggaatgattctttggcacattctaccaacaatttaacatgatacaaaatcattttcatatcttgtgatagtgtcagccaagtgtttcatacacatggagataagtgctgaaaaaggtgtttgaataaaattgttttcttaaagcaactatagaggatgagataaaaggatgcacaattacatttcataaattgagagagtttcctaaacaagagagcattcctggaaatgcagagaaaaataaaaagatcttaaagatgttgtattaagataagttagactaaggcagcttggacatgtgtctcctttacttcatgtttatatataagtaaacattaaaagtagaggaatttcagtttccacataacttatataggagcaacaaatggggctttcaactactgaccacattggcatatcacccaatgttttctttcagacttctctacctacgacaaaaccattgtggtattagagcttcatgaactgtgtatctttgattagttgatttaacctgtctggccctcatttttctcatctgtaaaataattgagtcttatgtgatttgaagatcaaaagaattactacacaaacagtgctagtaagagtccctgccacatagaaaggctagtacacacacacacatacatatatacacacaccccctcatacttttatatattaaaggtgtatgatttatgaattattgcattagaaatgtaaatctgttatatatatcatatatatgataagtgaaatacagattatgtaatttacaccacctattttattttgtaacttcgtaaacagattttgaaaattttattttgtgtgtatgtcttccaagtcattccctaaacttcattaaaatccctttgatttatgggaaaatatctgtatatatcaggtattcatatatataacacatataactcttctgaggttataaacacacatatatttataacatagaaaattactaactcatatatgtgcctatctatatataattttcatatataacattgtatattacatataaatatttatattacatacgaataatcatcacgttctgacagaatttgttaatctaacctccctcaaccccaccccaaaaaaagtagaaactaaaaatagaggaattttaagttccacatgatttatgtataagcaaaaaatgggactactgactacagatcacgttagctaattgtacagttttctcttctgtgctttgttgtaaatatgatttttatttaagaggatattattaattatctatacaagaattggctatcttctccaaacttctacttcggtttcatgtttttaaaaggggtgaggataggctgagcacagtgactcacacctgtaatctcagcacttcaggaggccaaggcaggtggatcacttgagggaaagagtttgagtggcctcgccaatgtagcaaagtctgatctctgctaaaaatacaaaaattagccaggaattgtggtgcatgcctgcagtcccagctacctgcgaggctgacacaggagaatcacttgaacccactaggtggaggttttagtgagatgagatcatcccactgcattccagcctgggtcacagagcaagatactgtctttaaaaaaaaaaaaaaaaagtgaaaagggtgaggattgttatttctatgggcaggcccacacagcattggattcctcagaaactgcacagtaaacgggagtctcttagcacatctgacagaacttcaaggggctgactgttcattatcccacagcccactctgctctgtgtaagtggagactccatgtctttgttgtcttgcagtccctagatgataagggcacagagaaaaatcacagaaatcaaacatggtagcacagaaaaacaccccaaagtcaaggataagatgaaagttgtgatcgtacacatcaaagtcggactcttatctagatgggcacacctaagccacaggctgacaggctgagattctacaaaggctctggaccccagataagtttaagtgattgcatcgtgatctcttcttttcattggtggaggcagtgctttgaatgactaagctggatatcactttccagggaatccttttagggaatgtgaccatccagctatctctggatgtctttggtgccataaatacttttcacttggttgaggatacttttagttttatattcatgcgtcaacttgtacagaaatgtgtgttttgggcttgtaaaaaagtttaatcataagacaaagggctacaggtttcatgtttattcacagtttgatgaacggcacttatggacacatatgtgtatacggtaagtgctcactgaattcctcttgagtgataagctaggatacaaaatgtcagaagataaagagtgaggatgggcactggatccaaatgtcagtgaactctgagggtctcttgctggttgaaacaacagagtacttttattttcattctaaaccctccatgacccatgtccttataccaatgaatcacctcctcaataacccctcaaacatggcatctttgaagtagagcctcattgacaagcactaattaaatgtctgtcatggatactaaaatgtatatacggcctttgtgcctggacaacagtacatgtgtcagctgtttcttaagcctacatccaaccattaagtaaagcccagtgcgctcttagttcctcaaatctgttcaagtcttgatgtttgttcaacattttgcctggctccagtcatatgtctccagctatctgtaatggactcaatatcctgcttataaaatgctttagtcatgtgggttcatttttggtttagctgtataggtcaggaataagttagaaataaccaaaatactccaaatcaagttctagctgttttgatacaaacattttccatcaaccttacttctccctaactcatctgtctgtttctgtgccctttcccatggggtaaaaccttttatagtatccagatgccttctacacacagaagcaattttgtgcaaaaggctccccaggggaagaagaggacaatgccttcatgggaagctcctttctgttaaatcggatttgcatacctaaccaaagcatttgcttcagttaaccaagtgagggtggagaaagtcttgcaaaactatagctacattgagagggattattaaaattattcagtcattcattagaggagctttgacaaagattgcagaaacagatataaaacaggaaatattaacaaaaacattctcaaaaatattttataatgtccagaacaactggcatgactaacatcaaagaagggatatgttttgacattgatttactaaccacttatcattgatactaaatcctcctttgaatacttatttacgattaagacagtcaagttatatgagtatgttcaaccaacaaaggttgcaaaacatagtgaatttaatattcctctgccatatggccatcctacacttctgcatcacagtcatggctctgcaaatagatcagactttttggccagtcccttgggggtcactgcattctaaggtgcttgaccaggaagtaagatgctcttctcactaagtgatatacgtgtggtccttgtggatctgctaagaatctcagaaaaggaataaaagatacatgaaattgtttgcatgctactagctctagtgggtagattggtggcatatttcttcttggcaaaagacagaaagtatccaaaagttcaccatttttctcctggttggggaatggtgtcttttagaccattttgttcaaaagaaaggtaaaaatagcatgaaaagagaacccctaaattgccttactcaagccttctactctaagtgacttgtataaaatgtcttgttcagtagttacccaactccaatctacccctaagaggttctagtaaagtacagattagctggatttaataaagcacaaataggtagcagatgcattcttacatctcaatctaatcggtaaccttctttatcctcacccatggctgactactatgcataaagaataggaattctgaccactcaagaatcttaaccatacattcagtctgttgcagtttctcctccattacacatttttttttttcgcttttctatccttggacagccacagacaggacaactagtcaataagaaatgagtgtgaaggtgacaactttcctcactaagaggataggggccatgagaggaaaagggtacttcttgtgtggctggtaatggagttaaaatttgatgctacagtcttctgggagcagcagctgtatgtgcttgaactttactttggaggcatcctctaattccaggggttctgtggccagtaccatccactgcagttcacttaacttgggctgagtctgtttcttccctccatcacttcagctggacctattctttgaccctcacatggtttccagtggtgaaaccagggaagagtctctttgtagaggaccaaggagcacttttttctatgtagtgcacatttggctccatcaccatcatagctaacatgtccaaccctccagcatcttcaaccttcgccactgtctttgcactgccccataaggcctgaataaggctgatgggtcatgtatggcagggccaccccaacagtctagtaataggtcttgcattgttggacacacttcttgatttagaactatggctttcagtcatggttaggtgtgccccagttggcaaggtaaggagacatttccagttgttacagtgagtttgaagggtgttaatgcatttagttcatggagaccagggttgctgttcaatatcctacaatgcacaggacacttgcccatagcaatgatctgattccaaatgtcaacggtgctgacatcagtaaaccctgctctaagtcaatgctttttttgtatgcatattttaaaagtctcctccagctaaaccattagcttttaatggggtatacatttttctttccaagggatgtttggttatgcctggagacactttcagtttttgcagccagagtttggtgatgtttctggtatctaattgatactaatcctagatgctgctcaacatactactatgcagagtatggctcaccagaacaaagaattatcccattcataatgcctctagaattaagattgagaaaccttggtttagaatacagggagagctagtggtatcctctaagatgctgtctggaagcagctttgaagacaagcagagaccagagactttgaagccatactcacagggtttgatatagtttggatattggtcttctccaaatcttgtgttgaaatttgatccccactcttagaggtgggacttggtgggaggcatttctgtcttgggccagatctctctcatgaatgacttgatgcagtcctccagatgatgcatgagttcttgctctgttatttcccgggagatctggttgttataaataacctggcaccttcctctcctctctctcttgtttcctctctcgccatgtgatctgtgcacacagcagctctccttccccttccaccatgaatggaagttcccttagtccctcatcagaagcagatgctagtaccatgcttcttgtacaccctgcagaactgtgagccaaataaacttcttttcttttctttttattcttctaattagagacaggatcttgccttgttagaaaggagtacagtggtgcaatcattgctcactggagcatcaaactcctaggctcaagccatcctctgacttcaacttcctgagtagctagaactacatatggcatgcctccatgtccagttaatgtttattaaaaatagttgtagggacagagtcttgctgtgttgcctaagttgttctcaaactcctgacctcaaaggatcatcctccttcatcctactaaagtgctaagattacagatgtgagctgccatgcctcgactgtcttctctttataaattactcagccacaggtattcttttatagcaatgcaaatggagtaagacattgtacaaatcccacattaggcacttatagatctgtctgtgattctggacaagttatttaaccactctttgtgtctaaacctgttgtttgtttctttctttattccttatcaggtccagctccaatgatgataaaaatatagatgtaaatggagctaagaggggtgcctgaccaagagtaaacagtccagaagtgttattctgtcaatatgacttggatttttgcttcgaaacttcagctgaaactgacatgacaggaaaaggcccaaattagaattcttcttatgcaaaattccttctgtgaggaggtagcccatctgttgtcaaataatccgagttgtagaaatttattaaatttctcctttcttgccccttgcctccttcattaaatgaaatcagatggtgacagtataaggaagttaaagtgaaggtaaaataaaacagacaggaagaagtctgtcttcagattagacatgcaattattcctgtctttgctgctgatttcaattataactcattggaattatcagtccacaatagatgttccctgcctatgtggtgtttttaattaaacgttgacatcattctcacatgttcactgttattagcactgatggatgtaatcttcatgttttcctctgaacactgcatgccaagaaaggggccctctatcctcacggattttctaggcaagagaatatcaggccctcatctgtcatatttccatctcattcagcacaaaacaccctggctcatggaaactgcaagcatcgttgtcagctgcacctgcaggcaccacgggattgcaagtcagcataccctttcagaaatgaggatgaaattagaggtagagagaaaattctccactgtcctctcacttgtctctgttatggtttctgctatgttttcattgattatgctatagggagaaaggaggaaaagaatcccctaagaagaacagtgtctcactggacattgtttctttgcaaaaaaaaaaaaaaaaaaaaaaaagaaaaaaaaagaaagaaagaaagaaagaaagaaagaaagaaagaaaaaaagaaaaagaaaagaaacatttttggtatttttcactttttccaccctagaatctagataccacctttaaacagatttgaatcccacagggagaatgtggtcatatatttcactacaaatgctagaccatgtcttctggcgtcagaaatgctgtattgtgcatgtgttcttgctgcaagccatcttcaacttggtttttcagggataggcaaaacattaggcaatctgaataaaattgcatttcttgcaactgaaaatttttgcatgcacccacatacgtgtattggtattactgtacagcttgcatggtgcaaagctgaaggctaagggattaaaggaggctgaaatttagccctggacacactgtgcagcctgggtacctgtagggctgcaattcctggctagaggtgtgtctatttctcatgcatccagtagaaggcacccttttgaaggtctctcaaccctctcctcattcccctccacctatcatatttagcatattgtgtatttgtccttagtctgtttaatccaacttgatcactttgtagcctttctttattcccagtgtgtaaatcagtattttgaatgcattgagctaagtttcagacatatgcctttccaaatagactatcatgaaggatgctattctggcgcagctatgcattctcttctgtgtaagaatgctcattgtgtagtctctccttttaaagtctgtttagtgtaatgttcgctgacttttccatgcacctcttatgtaatcttttgccagttctaccatttccaataaccaatgaagatacttgcttcatgttaaattctaagtaatctactttctattgaactaaatcatttctccacaaaatgtctttgaataattaaagatcttataatgtggtttccatagactgaactgaatatttcatgtggctagataagtaggtaaagtacagtatagtagcaattggtgtacacacttagaatgtcctaataaattattgcagatactgatatgcaatgagaaagaataactgtagtgttaagccccagatggtattatagacctgagggtgggtgaagatgggcctgggattaatggattgatagctcagttcatattggagtttcatatctgagattcagtgaattcgaggctattcttcacctgctgcaattctagggaagtgtgtccattgaggagtcgctgaaggggctgggagtttggatggggttctttcaatacccaccttttaaaaaaaaatagtgtggctctgtcatgcaggttggagtgcagtggtataatcatggctcactgcagcctcaaactcctgggctcaaacgatcctcctgtctcaacctcccaagtagctaggactacagctgggcaccaccataactaggcaattgttttaaaaactttgcagagacagtcttgctatgttagttagggtggtctcaaactcctggcctgaagcagaccaccaatgttagccttccagggtgctgggagtaagacatgagccaccgtgctgaactgcaatatctttttaattagcgggaagtagaaaacagaaattctgcagcatgtttttcttgttaacatgaatcagtcttgggtgaagtgtccatagtttttaatgatattttcaaaatgaacaatttagagacaggcatcagaaaccacaaataataaggccatgtgaaggaacacaatagatgcataaggttaattggtcagcatttatgctgcacttagtttcccgttgatttttttttaatgagtttgaagtataacacacagaaaccaaagttctgtgttttgtattatgttatattatcaatgttcagtgcaatttgaaagcctaaagcaagtatttctgtaacaaacacacatttcaagaaatataatgttcctatcttcaaagcaattcatgctctttcccattttgtctccttatcctcctcagtgataagcatttttctcttatgcttttctttatattttccatgcttttctttatattttcccaaaaagaaaggcatccctgcatcgcataaattttgcttgtttggagatactaaatgaatgcaacttcatattactttccgatgtgttcttttcaggcataattctgttttataaaattcttacatgctgctatgtatacattcattccactacttttaattgttgtatagtgttctaaaatctgaatatatcacactccatatttccattttattcctaattgatacagatactttttccagtttgaggttattatggactcgtgttatgaacgttgtttttcacgcatcctcatttctcacaagcattgattttctgagatatataccactatgtaattgctggttcaaatcttcaactatatactcttttgcagtacacaaatgcctgttttcaccagcagtatgcatcgttcaacatgtagcagtataagaattctgttttcttcttctgatctaatgggtgtatgtggaaactcactgtgtgtttattgtgttttccctgggattgagatgtttccatgtatttattggccgtttgtttttcctgattagtggaagcatctgtttgtttttgattagtttttctattagattgtgtgtcttcttattgttttattttgattagagtacttcattgattatgtatgtcacaaatttcttcttatgttttttgtttttaattatttcttatctattttttttttttttgagatggagtgttgctctgtcacccaggctgaagtgcagtggcatgatcttggctcactgcaacctctgcttcccaggttcaagcaattcttctgcctcagcatcctgagtagctgaaattacaggtttgtgccaccatgcctggctaatttttgaatttttagtaaaaacggggtttcaccattttggtcagactggtcttgaactcctgaccttgtgatccacctgcctcggcctcccaaagtgctgggattacaggtgtaagccacctaatgatttctttaaagttcttactcttagtttacacactttaccataatttttttcagattagcactttgggatttttgttaatggtatcttttcctactcctagatatgaagatttccttttactttatctgcaaaaaggcttatgattttatctttgatattgaaaatacacattgatttatttattgcattctgtaagaggtgtagtttattttcccttagaatgtcacaataccatttattttaaacaatttaacccatatcactaaagttcaactggtctctgtctaccactgtgccagtaatcacattttttatcatcatgattttataataatacaaaatatctagtatagcaaatattctttccttgttcttttgcaagagagtcttggctatctttggtgtgttgacttttgtatgaattttggcatacccaccttgaaaaataaataagcatctgattttcaattaataatgaattgaattaattaattacttaatctcaaggctagtttgggctgattggacatctttaaacattgaacagacatattcatggaattgtacatccttatacacatttatgtattttagatttttttctatttcatattctgtactattttgaatagcagtcttttatacattttggttaattgatttgtaagaaaagatgttttcaaaagtatggtaatgtttgttttaaaatgttcattctctgttattgctaaaatggaaaatgccattacttacttgttgaacattaattttgcaacttgtgaaactcttgtattctttgggatttcctagaacacactcctatcaactgtgagtaaaaacaattttgctattcctttttaatttttagatgtgtttatttttctctccttaacagctcattcgtgtaacccttcaagtacaatgccaaatagaacaaagacttgagcatctctttatgacttttgactttaaagacaaggtttccaacaccctaacccattaaaatgaggtcttcaattctactgacttttagttgtgaatttttattagattaggaaaattcccttttattttttgtttgctaaaatatttttgaagctgtgaatgaatgggtgttgcattttgttattctttactgaatgtagtgtggttttttggtttcttttttcttttcttttctattttattttattttatttttttgagacagagtcttgctctgtcacccaggctggagtgcaatggcgtgatctcagctcactgcaacctctgcctcctgggttcaagcaattctcctgtctcagcctccccagtagctgggactacaggtgtgcaccaccacgctcaactaattttttgtatttccatagagatggggttttactgtgttgcccaggctggtctcaaactcctgagctcaggcaatccacccacctcggcctcccaaagtgctgggattacaggcatgagacaccgcacctggccaatttttttttctcttcaatgtcactgtaatgattttattatatatatattacatttttgtaacataattataatatataatatattttatatatataaaagatgactttatataagatatataaaagatgattttatatatacataaaagatatgactttcttttatatgtgtttatatatatacataaaagatatttatagattttaatattaattccactttgtgtgttgggatgaacctaatttgagaattatatattcatatgcttttcacgcattgccgaaaatagtccctgggtgatgttgttggcaactttcttaatcctattctttgaattttggatagaagttacactatcatacaataaaattgaaatatatgtcttttttttaatacttgaagagattaagattggggatatatcttcattaatatgttcctgaactaagaaataccaccgtctccgcatagttttccttgtggcttgagttttggcagcaaatttgatgtcttcctttcttttgtttctttgttttgagacagggtctcattctgtcatccacactggagtgcagtagtacaatcatagcttactgcagcctcaacttcctgggctcaagcaactaatttggtatcataaatgatggggggactgggtgtggtgtctcacacctgtaatcctagcacttgggaggctgagacaggtagatcacctgaggtcgggagttcaagatcagcctagccaacatggtgaaactccgtttctactacaaatacaaaaattaaccaggctctgtggtgtgtgcctgtaatcagctcctgagtaggaggtttaggcaggagaatcacttgaactcaggaggcagaggttgctgtgagccaagatcacgctgctgcactccagcctgggtgacagagcaagaatccatctcaaataaataaataaacaaacaaacaaacaaataaatgatagaaggcttattcagatgtgtacttttgaatcacttttgttctactatactttttcaaagaagtctttttacttcttttaaattttcaaatttttgaaaatgccaaggaactaatttttggttttcctcttcattctattttatgttgtttttccattaatcactactgctatcttaattatttacttctgataaatcttgctgttgttttactgtcttcttgaaatgctgattttattaactttaagatatgcttcttttctcatatgttaatatatacctggaaattttgctcaagtactgaattagctacattccacaaatcagataaatgatacttttgcttttgttcagataaactattttgtaatttctattattaattttttagtcatgaattatttcacagattattctttagtttccaaatagacttgttttttttctggttgtttatatttttatacttcatttatttctcaccagtgtgctttgcatacttgagaaaagtatatattttgcaatggttggtgcaatatgttatatgtctaatatctcagactgttgaagtatgttgctcacatactctatgtagttttataggtagtttacatgttctttcagtaactaaaataggtatatgaaatttccccttgatgtttatggatgtttaaaacctttcctatattttttcaaactttagttttttgtgtttgacgtgcttatcaattttagtggatatggtctagaattgttattgaattgtggcaaattgaggttgttctcattataaaatgatcctctttaagttttgtggtgcttcatgccttaatgtctgtttagtctgacattaacattaccttatgttttaatgttaatgttatcttatgttttgttaataatcgaattgtgtattgtttctatgtgtttacttcaggcctttctgctggctcaggctttgagtgttttctatgtagcatctatttgggtctcattatatttgacttttaactgcagattcactgatatttactttcatgttttatgtatttgtgttcaagtcctctatcctaaattgtgcttttaatatctcacttctatatcttgcttgaattgctttttaaaaaatcattccaggccaggaacagagtctcacacctgtaatcccagcactttgggaggccaagacaggaaaatcacttgaggatcctccaggagttcaagaccagcctgagcaacatagaaagatctcatccctttgaaaaataaaaataaaaattagccaggtgtggtggtgtgcacttgtagtcctaggtactccagaggttgagtaagcaggagagtttgagcccatgagattgaggttgtagtgacctgtgatgacaccactgcactgcaacctgggcaagagccaagcctggaacaagatcctgtctcaaaaaataaacaaataaataaaattattccattttctttactcccacttctcccactacactagctgttaaaagactgtactacttttagtaaataatcctagaaattacaacatgggtccttaacataatcactaaatttaattaatacatttcctcttctctgaaaatagttagtaatcagtgtgttttaactccatgtttatgacctaacttacttgctgttagtacctttcgatgttttgtgttttttaggaatctttttcagatatgattgcttattttgttatttcaatattcattttgattttttgacaattacactccttcatttgtgtttcatttctctttgtacctcctactttatctgtgattattctcttacaaaatctattggtgatttaaaatatattttcagagctagtgagctgttggaagctctcagtttgcatggctaagtatgtctttatccacttcttgaacaattttctcgttgaattttaattttacttctttcagctattcaagaaatcattctcctattctctggattccactgttcctatggagaatttagctgtcagtttaaaagttacatacttaaaaataatatatttgggtggctacggtggctcaagcctataatcccagcactttgggaggctgaggcaggtggataacctgagttcaggagttcgacaccagcctggccaacatgatgaaaccccatctctactaaaaatacaaaaattagccaggtgtgatggtgggtgcctgtaatctcagctactggggaggctgagacagaatttctggaacccgggaagtagaggtttcagtgagccgagatcacaccattgcactccatcccaggtgacaacagcaagactctgtctctctctgtatatatatatattaaatatatattaaattaattaaatattatatattatacatttaatatatatatactatatacacatatacacacatatatgtgtgtatacatattttatacatatatatatatatatatatatatatatatatatatatatatatttggtaaagttagtttgtatccccttgatacctttaagatagttttgctttcagtttctgccatttcagtgtgatactgtttggggtttattaatctgattagaattccttgatcaccttgaaatctgccatgggcttttcttctgttctgaaaatagtcacacctcttcaaatattgctactgtttcttctgttttcagtgtgtttgtacataatttagattttctccctctggctccttttttagtttttgtgtgtgtgtgtgtttgcttttttaaaaatcttcattttcaagcttcattctggattaattttcctataacctacttcactaattctctcgtttaatctatctaatccatggctaaaccaatgtgtccaatccttaaatttgatatgtattttcattacatttcaaggttgaatttttgtttcttctcagtttccacatttttaaagttctcaattttgtattttcaggaatgctttcttcctggttattttaaagtctgcatctgtttttcttccttttttacccccctatcactcttatgtttcttcctctttgtttgttttttggtatcactgactaatatcttcatggactaagtattagaattatgcatatattcagcattctcattttgtttttcttatttctagctctctattttatattctttgtatattacatctcatgttgttgcccaggctggagagcagtggcacaatcatagcttactgtagctttgatcttatgggctcatgtgaatctcttgcctcagccttctgggtaagtgggactacaggtgcacaccatcatgtctggctaatattttatattttaattttttttagtgactagatcttgctctgttacgcagactggtctaactcctggcttcaagcaatcctttctcctcagtcttgcatagttgggattacaggcctaggccactgcacccagtttcccaacgtttttcttctttgcatgatactctctggatcatttcttctcatctcttcccaagggtatacgatatcctttttaacttttctgcccttaggcagatgcattcattttctcattttgtttatttctctgatctagaaatttgatttgatctttattttttcattcttaatactttcttattcctggcagatgctttccaacttgttgttttcaaggtctttgaacgcccttcagaaaattggttatcatatatatatctggtgactgcactatcataattcttttggcatttccaccagcttttgctggtgactttttgtttctttcttcatgggtttggtaatctttgtgaattggctgctgtatttgcaaatggattaagggcatcttctgaacctgtggacactggaattcaaggttctttcattcactgagccatgctgttccctgaatttcttagatgctatgaaggtagattacaagtccttgcaagaccgaatttacttttgtttaatgcttgccttcagggggaaacctacaaggtaggaaaatgttagaggtgagtatattagattgtataccttcaggagtgactacggtttgagaattgtcccattatctgctgatgctgcaagaaccctaactatttcttcaagattggaacagtgcactaaggcaaaggctgcactgtgtgccaggcgtctagatagaccatcatttggtcatcagtgttttttgtttatttggttggttgattggttgttttgaggcagggtctctctgtcaccatgctggaatgtagtagcatgatcatggttcattgttgcctcaaactcccaggctgaagacttactcccaccacagcctccccagtagcttagaccacagatgtttgccaccaggactggctaatttttaaaaactttttgtagacacaaggtttcaccatgttgcccaggctgtgatcatcagttttgaagctataatcttaaatataattttagcactgaaatgcttttaagagacttttcaaaaatcacacatattacaacccactttcaattagaaggttggtctgaatgatcttctctgttactgctagatgtagacttctgatttccgctgatatccacagaaatgactaggtagaacatgaatttatagagataattcaaatatcttattagcactccattatctcaagagcagttctgagttcagagaatcatgactttcttttacaggcattaaaataagttaaatcagcaatattatttctaacaactaacacttcaaagaaatgtcagacagttaatcatcacctgacaccatagctcatgcaaatcgtgttttatttaggatttatgttactgctagcattttggatgaaaagatactgtttttttttgttttgttttgtttttttgtttttgagacagagtctagctctgtcgcccaggctggagtgcagtggcgagatctcagctcactgccagctcctcctcccaagttcacgccattctgctgcctcagcctcccgagtagctgggactacaggcgcccgccaccacgccgggctaattttttgtatttttagtagagatggggtttcaccatgttagccaggttggtctcaatctcctgatctcctgacctcgcgatccgcccgcctcggcctcccaaagtgctgggattacaggcgtgagccgccgtgcacagccaaaaagatattaacatttttctctgaagcactgagtcatacttttgttttttcacaagattttttacacttttcaattagtatgtgagtgttcctcaggaaatgcatgtttggctattttgctgttttagagtgtttcatctttgaaatgcatgattaaaagccattttagaaattaacacgagtgtgtttaaatacaaattatgaagccagtgttttgtttcaaacttagggatataatcttttttttccaagaaaatgctctcatttatatatacatgaggttatgtaagacttttaaagattgatgatggatttagtgccagctgttgattagtatgtctgcaatggatctacaatatggcaataacactaggtactatgcagagttactgtgaataataaataagacacgatgtatataattcacctagcagacttatttgtatactataattattcaataaataatggcccttgtggttatttatctattgatagatatttatgttgatttatctactgatcagtcctatagcagtaaatttatctttaaaatctagacacattaggaaagaacaatgttagattttatgtcaaaaataaaatttcttagtgtactaaaataatatattttttctattaatgcaagttaggcttttatattgattattttgaatattttactatgcttggtatgttttaaaaatttagtagttcttaatgcaattctacttttaaaaactttttcattatctagtaagatttactagtgattaattttaatttggtagacatgaaaaatacacaccagtttttcacacacaatcataaatcctgtacatcatattggtgaagcgggaactaaactgcatcaaatttccactaaataatagaagagcaatctatgatgtaattgaaatgttaataaatattgtagaaatgggaaattttcagaatgttcagatttgtcaagagaatctcaaagcgtgacacttttctgtaatctgtcatagataaatcaggtcttttgttatgttgtttttctctttttatttccaattcatcacaaaaatatactttggtttatgaatatgtaaactatagagtagtaaatttgacaaagtctacgtgttgaaaactacattcgaccactgagggacactgatgaaggcttaaacaaatggagaaaagactgtattcacaaacacgacaccctcctaagaagatacaatattgttaatatatttattttgtacaaattaatctacagactcattgcaatcccaaatgaaataatggtagacttttagaaaatacataaattaacaagatgaatttaaaatttaaatcaaaatacaaaggatgtgcagtagccaaacatctttgtaggagtagaacatattgggaggactcctgctacttgacctcaagacttagtgtggagctatactgattgaaacagggtattattcatataaagatagacaaacagatcactatcacagactggagactccacatggaactacacatatatggacaatgaattttccaaagaaatacaaaggcttatcttttcaaatccaactggaagcaagcagctttagttatattataaaatttccactaactagaatattcttgggtaaaaatgaagtgtcacctaaatggaattttcaaacttgcaccctatgtctgaacacgattctttttcagtcaggcatgtagttattgaggacacatttctcagctgtgcatacatcccatccagtcccatccatagatgtattgaaagcatgtgcttactgcaagagcaatgcactagcctttttcctagagttgggtctccaaagaaagggcctttactcagagtatctgcccagggtacaagattgacttaaaaccagtgttaacaacacacatggtactctgaaccatctgctggaggacctccctgtgtctgacacagtctatctattgaatgtcatggaaaagattgatggttgaagcaaatcactttatgcagttagaaaaagaccatgctgatctttcagtttttgagccacatctacctaatccacagtcagatttgtcagcctcagcactactgatatttgggacttcataattctttgctttgttaggcttgtcctgcgcattgtaaatgttcacagtccagataccagtacataaatagatacagtttttaccaattaaaataaataattaaaaaatcatctttacaggtaaaaataataagcagccagacacagtggcttatgcctgtaatcccaacattttgggaagccaaggctggaggatcttattagcctgggattttgataccagcctgtgtcatatagttagatttgcctctaaaaaaacataaaaaattagctgctgggcatggtggtacatgcctatagtcccagctacacaggagacagaggtgataggatcacttgagctcaggagttcaaggctacagtgagctattgatgattccaccacagtccgctgtaggtgacagagcaagaccctgtctccaaaaataaaaaataagtaagctaaatacttttgaattgaaaaaaatgtattctgtaagagatatctgataatcacctactatgaccatgttttcatccttcaaggatttcaaactattataaaaatcttctaaacctctatctctttagtttaaattacttacatgaatttaatgctccagtatgtgacaacaattattgattttaaaaaataatagatctgttttgatattcctttaccaatattcctcatgtttgtgagaaaatatgaggcagtgcagttgactgcatttgtatgtatttaatatcatgagcaagtgggaaaaattcagaagtggcaccgagttgatcatctctgttatcatcatgagaaggatgcacaatgtgaacattctgccatagggcttgtctctgtaaagtgcaggtcgaggggcatgaagagcttctactatttttaaaaacatctttctgaacagataatggaggcttaactgtagtgtaaacacgctaatgcacaaatcttgaaaaatgtaaaataaactgtgttgagattagaggtgatctattcacatttgaaggatagaaaatatgcctaccagccataaaaggggtgcatttacttttatttttgagaacagcatgagagcagaaagacacattaacaaaagggtaagagtcttcagagcagattactcccacttgaaaaaaatgagttaagtgattttacagcaggaaagatatttgcagcaagaagtttcattagtcaccaaatgaggtttctctgacatatattttcacagaatgtgaagcatgaggaacaataaaatttctatatttttcttgtgtttattcatttggctggaagattcccttccctagccttctggaagtttcagtcttctaatctgatttagtgacctttgttcactaggaagaacatagtccatttacgtttgccaaagagtatttacatgtatttgcagtttaaacaggaaacattctaaaaaatagagggtgtgtttgttgaaaacattatgactattaaagtcagagaagttacctaaaacagaagatgctcagagtttgaaactggatggttattaatagatgcttctttgtgttgactggagtttaactgccagtcctttcttaagccaagagattttcccaaaagaaacacttcagttgtaggcccagtaaagaaactggaatctgctttatgaattggcaataaaaagaaaaggtggggaggataggtgaagaaaagagagagggagtcttcagataggaaaccccccttgcttcccttggagtctcatcttaagatttaaattaaattgaagaccatattaaggaatagaaaatatcaggatttttctttgtgacacataatcaactttatctctcaaacaatttacatgatgacttacagaacgactgcatgatgttgattctacaaaagatgactgaattcattaggactactcatttgtcttcagttatactttctgcagtttcaattatctatggtcatccatggtcagcagaaaattccagaaataaacagtgcatcagttttacattgcccttggttctgaatagcatgatgaaatccccagcagtcctgctccctcccaatccatcctgtccagccagtgaatcctccctttgtttggcatctccatgctggtaaggctgcctgatctttagtcatttagtagtcttctcagtgaccagatctgtcatgttactgctgtgtttgtgctcaagtaacccttatttcacttaacaatggtcccaaagtgcaagagtagtgatgctggcatatttttacaattatcctactgtattgttagctattattattaatctcctactgtgcctaattgataaattaagccttttcataggcatatatgtataagaaaatgcatagtacatacagggttcagtactatctgtgttttcaggtatccactgtgggtcttggtacatacataacagaagactactgctgtccacatttgtagcaatgatcacctttctttcattgtgcaatggcatatttctcatttgcctctgatggctcatataaatggagttttctgtccatatttctagtgtcattctgttcaaagttgcataggtcttccttacgatgattaaggttttctctgcagcccttatctttttcctgagctctcattagaatcaccttcgacgttctactcatggcttcataggctctgtcgaccatacacttcaaaactctttcagattctacttattacccaattccagagctgcttctgaatttgtaggtgtctgttatctcaataccacactctcaggaccaatttctgtcttaggtcattcaggctgctatgatgaaataacataatctgggatggggtgggaggtgggttgtaaaaaactgacatttatttctcacagttctggaggctagtaatccaagatgaaggtactggaagtttcagtctcttgacagcccacttcctagtccacagacagcaacttctccctgtgtccccacatgggaaaagggtgaggggctctttgagatctcttctttaagggcactaagctcattcatgagcactccatactcaggatctaatgacctctcaaatacacatcctcctaataccatctcctgggaaagggagtttaggattttaaggttgaatttgaggagaatgctaacatttagtctataaaagaagacagtacaggaaaactacagaaatcaataaactcagctattgttttgattaaaatagagccaagtgcatttttgttttacatgttttactttatatttgttattattcttctaacaaacaaatacacatagtgatagttaattcttccatgatgtttttgaaaatgtgttgttctgcattggctataagtctcctctctgactttgaagaccttggaaagctgccaaatatctcagaacttgttatcttgagtcttaaagtgaataaaatgacctcagtactacctgccttataaaatgctctgccaattaatgcatacagtatgcatatactttgaaccaagtatgttttgagactgcaggtttggatgttattggaatacacttgactctatatttctttttatggaaacagatatacacacttaatgtcaaatagtttggatctttttatgagctaatatgattagctaatgtgattagtagaataagcagtctctttccatcttagtttgtgtatctgccttctcctagaactcaacacaaaatgagcttcatgattcacatttatgctaacatggagacagaaccaccttgtgcaaaacaggtaaaagcaggtataagatgccataaagggaaatgagactgaatgtgttcaatttcgctttgtttggcttatcatgtatcatagaaatgtgctcctacatgcagtagaaacaaaaacatcccttaacactctgtttgagcagttcaaaatcatattttttatgttgtgcgagtttcaggtgataaatcctcttcaagatacatcaggggttcacaaaaatgtaaaaaatatgttcaaagtttgaactgactcatatttttagcattcatggcaaagaactgcttttctagccttaataggttttcaaatggactttgatgtgttagtaaatcagaattagctttttctttttaagctcctgtgtcttatgtaaatggctgtgttgacttttaaggaattgaatattccagaaaatgtcatggaacctaaaacaacgtaacattctgatttttagatcttaaagggatatggtgttaaatatagcttttgatacccatccaacctgtgcaaagttttctctgtacatgtgactttcaaatttgagaatttagtatgtcagtgaagggaaatctgtatacctgctgaaaacaaaatagaaatagaaattctgaaggaattattgtaatttacttaaataagaactgtaagtagtcaaagactattagtggaatgacaatagatttcttttgagaccttcaaaacctttttactaccaaaacagctgttatattctgaaaggcagtctctctttacaaaaagcattatccagaactttaacttattttcacaaagaacattctacaaaattagtgtacctttgtttaaaaataagattctcctacctgaggtctgaaatttattattaatgtgaatattttaagcatttttagaagaaaataattttgtaaaagatgtaagttatgaaaaataccacagtgaagtacaacattcacaaacttactggaaccttgtcctaaaaatgaactaattattggatcatatggcaaactggttaagaaggataagaaattactttatatcattaaaaaccatatgactatccacctgcgcttctaaaactttttcctgttacgttctgctattttacttagaatttttgtccattacactattattttaggttaaggaacaatgtgtttagacagttgctcattaaagtactaaacagaaaaggtagtagattaagcttttcacccacaatttatatattatcttataatgtgtgagagacaacagcataataaagataaattcttcatcagtcttagtaacaatagggcactttttgcttttatgcctctcattttatttaaattcctttgtgaaattatgtaagttctttgaaatattgctttaaaatatatttagtttttaacatattttaaaaatatggaaatgtataacatgtgaaatttccctatcagcgtttcctgtatattttctccagctttgtcttgaattacagacagatattgtacaactataccacccacccacacaaatttattcatttacacatatttctttttagtgctgttttgcaaaattgggatattaattatacttctctgcaacttgctttacttactatttttatttttttctatctttttgcagctttgtgataatcccaagcattaagacacattataatgtcagtggaataaattagacaatacagtgccaattaactaaggtttccagaggcaactctttttgttattgatacaatgcaaatacaagtttttcatgcagggctgccagggccctggagtagaaatctaaatcataaccaaaacaaacattatcaccacatagaaagtaacaaaaaacatttcatgtgggtttggagtatttgaataatattttaataattaggttttaaagcagaaactgacagctttgtctacttcacccatcctgtggtgtcagatgcaggttatggatctggctgacagggaaattgaggtaggaaaataaaataaacaaaatgatattatgtacctgtgctttggtttaaggatgataaaattatttaaccttatgtccacattcctggagtggttccttacccctacctaagaaaatccacctcttacttcttcaactgttcagatctcaatcaacacagctttttgtcattagcatgctggaaatgcattgttttcatgaaatgaattactagttacatcaaaatgaatattagcatgaactctcattggcccataatgttaaaatattcaaaatatatgaattggctaaaataatttacagaaaatccctacagtggcattatcaaggtacaaaaatccagaggtgtctttgcctttgacctggtccaatgcccatggcttgaagtctctttagccctacattcagatgttgacacaggagaatttctcattacctgatgctgactgaaaaagataaaagaacatcacttattttgtccttagaggactgaaaggcagagaagctacaaatagaagttgtacctcaaaatttttgaaacaatacatatgaactgttttgcatctgctgtgggggtctgatgaatgacaatgtatgtaacacatttggctctgagacacacaggatgaaatataggtggagagaaggaattaataaccatcactcatctcctttttctgaggttacttttacctaccaaaatgaacctaaaaattttacctgaacaaattggctcagatagattgcaacattgactttattgtttgtcctagggctgcccctgggctgaacctaatgaaactcaggcgggttatatgaaaactgcaatagcctgtatctctacactttctgcaacctggtttctgcacagagaaatgctgcatgtgtttgctgtaggcaaatcttaaataaaccatgaccccacaagaagaagagaatgatgtgcagaaatactttagggaagggataagatggcaattttgaatgggagcccacagggtacaagtactcatattccattaccaacttcagaagcttaattactttggaaaaccatttttcaccttattttagtaatatgtcaagcatttcaggtggtctgcaaaagccgtatagcccatggtcttagcctacctcgtcaaacatcaggcagaaacactttctaaacccattaaaaagagtcaagcaggaaattgtgagtatatagtattaaggagatggacttgctattcttaaatttatagaaaaaaaaattctgtattttcttcgtcaatctccacttaatgacagatttgttttttataaaaagatgcatgacagataatacttatttaaacttacagcggtaaacacgatgaaatattcttgtttttatccagacatctgtaagaatttcagaattattacccttgacaaattcatgtatgactttttttgtggaaatcttcaacttttgttctcactgctccctgtcttcccccaccaacaaaccctgaatacgtgggaatttctcacaagctattatttaactgcattccacatgtccatcagatgtcctacacaagatgggttaaatcaaagctttttctttgtgggagaagataacaactgttttatattaaatgcataaaaatttttctcaatactacagggtgataaagacaagaaaaggccactttaaaagggagccatttgaaaaaataaaataaggcagaaatgcttcactttcctacccaatatggaaataattttgcaaaaactaaactctaatgatggaattaaatttattttatattgagtaaaagttacgttatgcatgaagcaacataaaaatttttggacaacaaagagtgattcaggacaacatagtcactactgctcttggtgtggtttttagggggttgcataattggtgagttccttaccatcacctcacctgggaagagaaaggggtcagggaactccatcccctacccaagggaagccctgaggagtgtgctgtgaggaacactgcactccagcccagatactaagcttttcctatggtctttgcaagccccataccttaggagattccctaagttcccaccagggccctaggtttcaagcaaaaaactgggcagccatttgggcagacaccaagctagcagcaggattttttttttcatacccaggtggcacctaggaccccattgagacagaaccatttactctcctggaaagagggctgaagccagggagccaagtagtgtagctcagcagatcacacccacacagagcccagcaagctaagatccactgacttgaaattctcactaccagcacagaagcctgaagccaacctgggatgctgtggcttggtgtggggaggggcgcctgccattactgaggcttgagtaggcggttttcccctcacagtgtaaacaaagcctctggacagttagaactcatcggagtccacccacagctgggcaaaaccactgtagccagactgcctctctatattcctcctctctgggcagggcaactgtgaaaagaaggcagcaaccccagtcaggggactatagataaaactgccatctccctgggatagagcacctagggaaagggacagcagtgggcacagctttagcagacttgaacattcctgcctgctggctctgaagagagcagtggatctgccagcacagcgttcaagctctgctaagcaacagactacctcctcaagtgggtccctgacccccaggcctcttgactgggagacacctccaagtacagtttgacaaacacctcacacaggagagatctaactggcatctggtggttgcccctctgtgacaaagctcccagaggaaggaagaggcaacaatctttgctgtgctgcagcctccaccagtgatacccacgcaaacagggactggagtggacctccagcacgccccagcagacctgcaacagagggacatgactggtagaagaaaacctaacaaacagaaaggaataccatcaccaccaacaaaaaggacacccacacaaaaacctcatccaaaagtcaccaacatcaaaaaccaaaggtagataaattcctgaatttgaggaaaaaccagcgcaaaaagcctgaaaattccaaaaccagaatgcctcttcttctccaaaggatcacaacttctcaccagcaagagaacaaaaccggatggagaatgagtttgatgaactgaccaaagtaggcttcaggagctaggtaataataaactcttctgagctaaaggagcatgttctaatccaatgcaaagaagctgaggacattgaaaaaaggttagaggaattgctaactagaataaccagtatagagaagaccataaaagacctgatggagctgaaaaacacagcatgagaacttcgtgaagcatacacaagtgtcaatagccaaattgatcatacaaaggaaaggatatcagagattgaagatcaacttaatgaaataaagcataaagacaagattagaggaaaaaagaaggaaaatgaatgagcaaatcccccaagaaacataagaccatgtgagaaggccaaacctacatttgcttggtgtacctgaaagtgacagcgagaatggaaccaagtgggaaacactcttcagggtattatctaggagaacttcagcaacctagcaagacaggccaacattcaaattcaggaaatatagagatcaaagatactccttgaaaaaaggaactccaagacatataatcatcagattcaccaaggttgaaatgaaggaagtaatgttaagggcagccagagagaaagtctgggttactcaaaaagggaagcccatcagacaaacagtggatctctatgcagaaaccctacaagccagaactggcttgtagggtttattcaacattcttaaagaaaagaattttcaacccagaatttcttatccaaccaaagtaatctacataagtgaatgagaaataaaattccttacagacaagcaaatgctgagcgattttgtcaccaccaggtctgccttacaagagcacctgaaggaagcactaaataaggagaggaaaaaccagtactagccactgcagaaacataccaaaatataaagtcctgagacactgtgaagaaacagcatgaactagcaaaataagcagctagcatcataaggacaggatcagattcacagataactatattaaccttaaatgtaaacaggctaaatgccccaactaagatacacagactggcaaattggataaaaaatcaagacctatccggtgtgctatattcaggagacccatctcatgagcaaagataacatataggctcacaataaagggatggaggaaaccaatgagaatgctgacacaatgtaccagaatctctgatctctgggacacaactaaagcattgtatagagggaaatttataccactaaatacccgcagtagaaagtgggaaaggtctaaagtcaacaacctaacatcacaattgaaagaactaaagaaacaagagcaagcaaattcaaaagctagcagaagacaagaaatagctaagatcacggcagaactaaaggagatagagacatgaaaaacccttcaaaatatcaatgaatccaggagctgatatttgacaagattatcaaaatagatagactgctagctagactaatgaagaagaaaatagagaagaattaaatagacacagtaaaagtaataaaagggacatcaccactgatcccaaagaaataccaactaccatctgagaatactataaacagctctacacaaatgaactaaaacatctacaagaaattgataaattcctggacacacacatcctcctgagactaaaccaggaagaagttgaatccctgaatagaccaataaaaagttctgaagttgaggcagtaattactagcctaccaaccaaaaacggcacagaatcaggcagattcacagtcgaattctaccagaggtacaaagggtagctggtaccactacttctaaaactattacaaacaatagaaaaagagggattcatccctaactcattatatgaggccagcatcatcctgatattaaatcctgacagagacacaacaaaaaaataaaaatagaatttcaggccaatatccctgatgaacatcgatgcaaaaatcattaattaaaatactggcaaaccgaatccagcagccctttacaaagcttatccatgatgatcaagtctggttcatccctgagatgcaaggctgatttaacaagggcaaatcaataacataatccattgcataaacagaaccaaagacaaaaaccacatgatatctctatagatgcagaaaaggccttcggtaaaaattcaacatccttttatgctaaaaattctcaaaaaattaggtattgatggaatatatctcaaaatattaagagatatttatgacaaacccacacccaatatcatactgaatgggcaaaagatggaagcatttcatttgataactggcacaagacaaagatgccctctctcaaaactcctattcaacataatattggaagttctggccatggcaatcaagcaagagaaagaaataaaggatattcaaataggaagagaggaagtcaaattgtctctgtttgcagatgacatgattgtatatttagaaaaacccatcatctgagccccaaatctccttaagccaataagtaacttcagcaaagtctgaggatacaaaatcaatgtgcaaaaaatcacaaacattcctgcacaccaattgtagacaaacagagagccaaatcatgagtgaactcccattcacaattgctgcaaagggaataaaatacctgggaataaaacttaaaagggatgtgaaggacctcttcaaggagaactgcaaaccactgctcaagggaacaagagaggacacaaacaaatggaaaaacatcccatgctcatggataggaagaatcaatattgtggaattggccatactgcacaaagtaattcctagattcagtcctctccccgtcaagctaccactgactttcttcacagaattagaaaaaaaaaactaccttaaatttcataaggaaacaaaaatgagcccatatatacaatcctaagcagaaaaaaaatagctgcaggcatcaccttacctgacttcaaactatagtacaaggccatagtaaccaaaacagcatggttctcataccaaaacagatgtatcgattagtggaacagaacagaggcctcagaaataatgccacacatctacaaccatctgatctttgacaaacctgacaaaaacaagcaatggggaaaggatttcctaattaataaatggtgttgggaaaactggcaagccatatgcggaaaacagaaactggaccccttctttacaccttttacaaaaattaactcaagatggagtaaagacttaaacatgagacttaaaacctcttttaaggacccacagcatttctgagcatcaacacattcatcatcaacccaaaaccatggaggcagaaggagggaaagcatttgaaaaactagaagaaaatctaggcagtaccatttaggacatagacatggacaaagaaaatacttcatgactaaaacaccaaaagcaatggcaacagaagccaaaattgacaactgggatctgattaaactaaaaagcttctgcacagcaaaaggaactattaccagagtgaacaggcaacctacagaacgggagaacaaatttgcaatctatccatttcaccaagggctaatatccagaatctaaaaggaacttaaacaaatgtacacacacaaaaaatcaaacaacccatcaaaaattgggagaaggacatgaacagacacttctcaaaagaagacgtaagtgcagccaacaagcatatgaaaaaaagctaatcatcacttgtcattagagaaatgcaaaccaaaaccacaatgagataccatctcatgccagttagaatggcaatcattaaaaagtcaggaaacaacaagttctggagaggatgtggagaagtaggaatgcttttacactgtttgtgggagtgtaaattagttcatccattgtggaagacaatgtggtgattcctcaaggatctggaacaaaaaataccatttgacccagcaattccattactgggtatatacctaaaggattataaatcattctaccttaaagaacatgcacatgtatgtttattgtggccctgttcacaatagcaaacacttgaaccaacccacatgtccatcaatgatagactacttaaagaaatgtggcacatatacaccagggactactatgcagccataaaaaagatgagttcatgtcttttgcagggacatggatgaagctgcaaactatgttctcagcaaactaacacaggagcagaaaccaaacactcttatgttctcagtcataagtgggagttgaacaaggagaacacatggacacaggaaggggaacatcacgcacccgggcttgtcagggcttaggggttaggggaggaatagcgtcaggagaaatacctatgtagatgatagcttgatgggtgcaagaaaccaccatggcacggtatatatacctctgtaacaagcctgcatattctgcacatgtatcccagaacttaaagtataagaaaaaaatatgtaaacaaattataataggaaaatgtcatattcatattatgaatatgtacttcaaattagctgttgaataaaattaatgaagtcacttaaaaaataaaatgcaggttattctggagggtattaaatatttatcagtaactatcatttgttaaaaaccaggtatccccaatatgttactggatgtgtgagaaagagtttctggagacgtattttggggagtccactacaactgatgaatttcatctcttctttgtctctctgtctctgactctgacactctctgcctctcactgattgcttctctctgtctttacatacacacacacacacacaccatacacagaatatttcagaaattctcaacacacaccaccagtaagtaatgccaacaattagattataaaactggcagtaattttctttcaatgcggctttctatttcattatgtcacaaataccaaagtaacaggtggacaatcaggatacattctgtcatgtttacattatgtaataactaatctaaaacaaatgcccagtggagggtttcttagctttctgtcagtttttcaaatgttttccctcttcctgcctccctggtctcaggttggcgatgcatgtgctggtgctcagagatgctatgggtccttagaaggggttttgagctggggcatagatgattatttccaaagcagtctgccaaaccctcagttcctgtaattctacacattttcaggcaatcgaaacacaatgagaaagatagtttgggtggttctcggattgcaaacttaggcagccacagtctcaactagcaatactaatttttctcatcctttccatttctacccagtgtataatttatataaatttcctctgcaaaccaaaaaaatgaactattccttattttatgatgttatgaatgtgtctgtgtcttagactataactgttggcatagaaaccagcttatgcttctataacttttgttgtatgatctttaaaattttgacttgctggtaaatataaatataaatatagaaataaatataaatataaatatatttgcctgagtgtcaaaattatatatataaaatgtatgactgtgtgtatatatacacaaatattttatgtagattatatatataatgtaatgtaaaacatatattacatcatatattacagattagctatatataacatatttgttttatatttatatttatatattatgtaatgtataatatatattttatataattatatatatataatttcattagttgtatcattttctccagtttgatttccagtggtgcagaacattttattcatattcctgataccaggaaagggtgcatattgacagtgcaactcaagtaaaatatttagaagacacatggctataattagttacttgcatttttcctgaaagcttttcatggtattgcctatttaagaatatcttgctttgctttctgagcaaataaactacactagcagcatttcttgaatctctttgatctgtgtggtgtgttggtgtggttttacacaggattttgcctatttttttttaagtgtggatattcctccttttatcttttaacaaatattgaaatattttaaaatttttaatactagtctcattaggaatgagagtttcctataattttcctggggtaatgttatacaattcatttcttaaaaaaatacttcttaaattttgttaatgttctgattatttttctgtcattattttggcactttgtattgttacattatgattccatatcctcctttgattccagcactgagaattggttttcatttctatgaactcattactgaggtccttgtttcttttgagatattaaacttgaccctgattttttttcttccctgtgagagtggaaattatcattcttttctactggttcagcaaaaaagaaatgctacttcctaaagaatatattttttctatgattaaatatgttttagataaaacaaaagctttttacatctgtccataaagtgtaggttttgaaattctcattggtgatagctatgtttattttcttacctgacacatcagctaccacagttaaattcggtgaactatttctgtatcacttactgatgaagaaataaatggctgtctcatgttggtaagtgtattgctgttccacaatctgaatatattttgcttaaaccttgaggtgttaccacatggtaaggattttaaaatcacactcagatcataatagtagttatctactttcaatgttgtaaagtcagatataccattgcaagtttaaaaacagagagtactttgtagtttaagtatctgatttaccttgataaacactttcatcaattttgagagcatatacaagctatattctgctcttaaattttcaaggtttgggggtgtgggggagagtgggaaggggaaggaggagagggtgagtgtgaggggggaagagggagggaggaagagaggaagagagagagagatagacagagagagacagagagagaaattgccgtggttcatggagccatctagctacaaatgtcagtttatgagaccagacacaatggctcatgcctgtaatcccagcactttgggatgttgaggcaggaggaatacttgagcccaggagtttgagatcagattgggcaacatagtgagaccccatcttttcaaaaaataaaaaatataaaaaattattcaggtgtggtggtgcctgcctgtagtcccaactacttgagaggctaagcctggaggatcattgagccctggagttggaggttgcagtgagctatgattgcaccactgcattccagcctgggtgacagcacaaaaccctgtctctgtataaataaataaataaataaataaataaataaataaataaataactatgtatgttctttccagcttttcatagtcccccaaagccttgcagccttccaaaacttgattttcttctaaatttctcagaaaattgaggggaaaatagcacttagaatttgacgacagctgtctacatcacctggaatctctggcagaacaccaattcagtctcttctttgagcttcacaacgcaggcatatattacaattttattaggttgagcacatatggcctttaccctcaggagttcctccatagttcctccatgctaatctccgtagagagaggcatttctccacttttattcaaattaacagcccataaaagaaaagacatcttaaaggctgcagcctctctgggacttgcatggggcgtctcctattattgtgcataatgctgtgctgaaatacaggtcaaatactctaacatccttttgctcattatatgaacattatgcatattgcagtttgaaactaggaagagagaagagcaatattacaggcgaacatgaatgcatcagaatatgataactttaaattagaagagaaggctctcaattttgaattctcagtgtttctcttctaatacacacaatgatgtctttcacatgattttaattttgattattatggataaataatagatgtatatatgtatgcagtgttttcccacaggtgtgaaatgtgtaataatcaagtcacagtagttgcagcatttattacggcaggtatttattccttctctgtgttaagagcattccagctctactctttagttattttaaaatacacaacaaattatttttattgaatcactctgctatgctaccaaatagtagatttttttcttttttgagacagagtctggctttgtcgcccaggctggagtgcagttttgtgatcttagctcactgccacctcgatctcctgggctcaagcaatccttccaccttagcctcctgagtagctgaggtgacaggcccatgacaccatgcccagctaattagtatcatttttaattttgtacagatgaggtctcactgtgttgcccaggctggtctcaaattcctgagctcaaatgatcctcctgccttgatctcccaatatgctcatatttcagatgtgaaactctgcccagctgataggaatctttcatagagtttcccaataactgagctttcaaagattttggatagcgactgagatagtgcaaagatctctctaaataacaagtctgaccagggaccttgtgttacttatatgaatacactgaggttgctgtctgtctctttgttaatgtataagcagagaatggtatattgatgcttatcagattttcagtttaatattgaagcattacaaattaaaatataaggtgtgggatacatgcaattttactttaggggtatgcaaaacctgagggcccccaaagcagaagaaggcattcagcccctactctgcatttcctccctcctgagttgccagccagccagccagcctgtcttacagattccagacttgccagttcccagattgcgtgagtcaattccttaaaatagatcgatctaataaatttatcctatattggtgaacaaatttagcacagaactttgatatatattagtaccacttattatttttagaaaagttggaatttgaataacttataccaaagtttaattcgtcatctggtgtgtatgttataaatgcacacccactcacagagacctattcatggcctcacataaaaataggcaatagatacaggaaaagacaggcagccatagaaggtcttagataagaaaccccatccttcgcacactcactcaagaacgttgttcccaacttctacatcttttgtagtttatatccactgggcacccctaacatccatccacattctttcatttatcccatttggaaataagcatctgacctgcactttctctgcctgatgtggctgtatgtctttgtttctctagcaaccatctgctcgtcttccaagagtcctcactgatcacatctcaactcctcttcacctatcctttcttaaatccactccacttcaccaaactcctcttgccaattatacaattggatcttaggccccacaaaagtggagctactattcctaatgttcctaaaaaatgaccattctgcattttccctccaatctccactgcctctatttttggaaaaaaatttcatctttgaaaaagcatttaagaccaactttttttcccactctggtgggaaaagaaatattgctgaatgcagaggacaactacatgaattcatactacttgctctggcaatattcccagatccttatcctggagcatttgtggtagttgggaggatggattttctagcagtatatagactgaatgtgtatgtcccccaaaaattcatatgttgaaacctagtcctcaactgtgtaggtatttggaagtggggctttgggaggtaataaggccatgagagtggagccccatgagtggaattcctaccattacaaaagggtccccagaattcctaccattacaaaaggcgccattgcaaaagacaccctcatcccttttaccatgtgaggacacagcgagaaggtgctgtctatgacccagaaagtgagtcctcaccagccactgaatctgccttgatcttggacttctggtgtccagaactgtgatcagtttttgttttttacaaaccatgggtacagtcttttgttttagcagccaaagcaggtaagataggtgatgctggaaagtaatggagatgtccacaaacaccctgaatcatgtactgcttcccaaccccctgtcctcctagcagagacagcaggaaaaagaaggcttacttcctccagatttgatgctcttctacccacagtaatgacagacaggttgccttatatttttattgtgtttggttcatctgatcaattcacaaattgctcaaatgtcagaaaaatgggtcaaagggccagtttggatttctgtggtagaaaaagaaaatgcaaaagactagatcctggtgtattcctagactgtaagaaagttcttattttacaaagccataaataaatatgacatttctggtgcctgagaatttgaggcaggtagtactcccgtgaagtaagataatgtcttatgtaaaataataaattcattcaaaaccatgggaatcattgtaactttcattgtcaagaaagaaacacataattttggatgtaggtgaacactaattattaaagatgattgttctcagaacaagtttattccgatttgtagctacagcaatctaagagaaaagcaatacagcaaccacaaccaatatgaggcttcttataatcatgttggggtggggatgcttcttctctgtcctacatcctgagaatgactgaaggtttcctcctgtcatgcgatcttcccttcatttgctatattctagatttgctagtctagtgcactcactccaggaactctgtacttgtactcagcatttactgggtggtgtatatctgtcacaggttataagtttcatgaaaagcatgtatcatgcctccctttttcctcatgcacgcatgcagcaagccaattaagggcataaaacacagcacataaagccctccattgattgacttaaattaatttatgaacagttgcaagggtaactgagggcccacatggttttcatgtatcatttaaaaaaattttaaataatgtgatttgattttttatctatattcttattctatagaaattaatctatcatatttcaatagtaacatggttgacattgaggtttaatataatatgttggaacacacatgataccttgattctgaatcaacactgtatgtgcaatttgatgtctgatgtatgatttggggcagtttgaagaccagacatttctttgtactgagcctctcccattccctgtgtgtgaagggaaccgtgggaataaatcagtcttcaatggataggacagttgcctttgtccctggaaggtttcatcaactgatcacagcagtctgtttttctgagtcaagatgcaacttccccttgatgtaggacactacatatagtgtagtgtgctattccatatctattggaatcatcacacatgatcagtcaggtttaatgtcaagtcaggtttaatgtcaagggtgtgatagatagaaatggatgcagatagtcttgcaaatttagttgaaccctctcccagcatcttctgctggcctcagtgactatcttcttgaatagaatgttctgggagtaatgatttgggacttccaaggatggattataaggaactattaagcttccatttaggacatttggagtgctgattcttgtgacatttccttttggaacccatacctcatgctgcaagtgttcaagccccatggagaagctatgcatggtgctccaatcagtagcttttgcttcatttccagttgacaaccagcagtgccaccatgtgagtgacccattaaggacatcccatctgattgagaactcctatcccttagctaactcaggaactctcaagagagaacttctcagctaatcccagtcaactcacagaattatgggagatcctcataaaagagtgtttgaagccatacattatgggcatgtttgttacacagcaatagctaaccattgttacacagcaatagctaaccagagcaggcattgaaaccagaagtgaggatctctttcaacagaaacctaaagtaagtggtgttggatttgaggccaaatggtatatggaagctagaacctccatggggcgagacaaagggcttaaagaacaaggaaagaaaattggaggctggggcattggaactgatgaagagaactctttgaatgactgactcacaacagtgagcacttttctcactattggtgagagaagtaaccttttgcattgtgcaactgcatgcaaactggattttgtcttttgaaatagaaagatggcatctcaacacatttgtcatgtgtagttcctaataagcttaatacttaacataaagttcacaggcctgtgttatttataatcttagtatagtatagtttacactggatggcaaaaggtcacatatacaatgacaataatagattcttttaaaatttattttggttacacttaaatgtaaattgtgaacatcatttctattttctattataccccatggcttttctattgtttgagtcatactaagtctatttttattgcataaattttgcaacatatattctaacaggaaaaataaaattataaaacatatgttttatatatgtctttcctttaaacgtgagattttaactaggttttcttcttctctgttactatgcatatgtctttttattctttggatcaatatattcccacatcccctggaacattttttggaaagttggcagtgctcctataaattctttttagtctctatctgcctgacatatatttaggttccatatatatttatcattttctacttaaatatacatatttccatttttatgctcatgctattctgcaaatgtctgatttttaaggatgagacatgcatttaaaaaggacatctgtatcttctttcagaatattttttccttaatatgtgttactttcatatttgaaatttcatacccacaaacatacacatacaaacatgtgtgcataatatacatctcacagaaatatccaccactttgggaaaatgtcatttctgttgaaaatgtctttacagccacaaaatatatattatttcttggcctaagccacagatcctctgtcaccactatcaattcatccccagggtctaatcacttgaaattaatattgtttctttgaagaatttcagaattaatttttttcctcaaaatttcatgaacttgcatgcattttttacctcagaccttgaacactctggacaaattcctttatccctgtaaattttttaactaattctaaacaaaatacctttgttcacttttcccctaaatttgctaactttcatgcattttgttttgtgacttgaaaatgctctggaaacacttctttatgcccatgattctttaattctaaacaagctacttttatcaatgctgacaaggttgtagagaataggaaatccttataccatattggtgggagtgtaaattctttcaactattgtggaatgccgtgtgataattccttaaagagctaaaagcagaaataccatttaacccagcaatcccataactgtgtatatacccaaacaattagaaattgtatcaaaaagacacatgcggccgggcgcggtggctcacgcctgtaatcccagcactttgggaggccgaggcgggcggatcacgaggtcaggagatcgagaccatcttggctaacacggtgaaaccccgtctctactaaaaatacaaaaaattagccgggcgtgttggcgggcgcctgtagtcccagctacttgggaggctgaggcaggagaatggcgtgaacccgggaggcggagcttgcagtgagccgagattgcgccaccgcactccaacctgggagacacagcgagaatccgtctcaaaaaaaaaaaaaaaaagacacatgcatgcatatgtttattgtagcactattcacaatagctaagacatggaatcaacataaatgtccctcagtgtagactgaagaaaatatggtacatatacataatggaataatatgcagccataaaaaagaacaagatcatgtcctttgcaggaacatggatgaagctgcaggccattatccttagccaacaaatgcaggaacagagaaccaaatactgctttttctcacttgcaagtgggagctaaagatgaaaacacatgggcacagagcagagcataatagacattgtgacctataacagggcagagggtggggagagggagaggataaggaaaaataagtatcagtgtactagtcttagtacctgtgccatgaaataatctgtttaacaaacccctatgacagtagtttacctatataacaaacctgcacacatatccttgcacctaaaataaaagtttaaaaaaataccagcatccactacatgtatggacagttttcttgggtttcacctcagaaaacactgctaaaattcaagataaaattactttgattacatgggttaataatagctctctgtgtgtgtcttagtcccctctctgtttcctatgtgtattacttgatttctaaataaactgtagaagctccaagtacttatttgaatctctacatacaatggtgccatgttatctaatttttcctttaggatgtgtacaaagactgtacaaaatatttgaattgtgtaatggtatccagtatggataataaaggataagtaaatttttgagaagtcagttaagtccgggcgcggtggctcacgcctgtaatcccagcagtttgggaggccaagcgagcgaatcacgaggtcaggagatcgagaccattctggctaacacggtgaaaccccgtctctactaaaaatacaaaacattagccgggcgctgtggcggctgcctgtagtcccagctactcaggaggctgaagcaggagaatggcgtgaacctgggaggcggagcttgtagtgagctgagatcgcaccgctgctctccagcctgggcgacagagcgagactccgtctcaaaaaaaaaaaaaaaaaaaaaaagtcaaaaaataacagatgctggtgaggttgcaaagaaaagagaacacttacacaatatcggagagagtgtaaattaaatcaatcattgtggaaagcagtatagtgactcctcaaagagctaaaaacggaaccaaaaagaaaaaaagaaaaaaaagaaaagtcagttgaaatgtaatagatacatagatgtctaatttttcagttctgaactatggacatttttgcaaagatacatgcttttcacttcaggaggtatttgtcaaggtctggaaaaaattttggctgccacagctagattatgggagtgagtaccactcgcatttcaaggccagaggccagagatactgttaagccacccacaaggcataggatagcccagcacattaaataatcttccatctacacatgtcaatattcctgaggttgagaaacccagatctagagtaatattgatgagcagtaagtataggccgaagcctcgttttccatatggctgtgatagattttttaaaatagtcattggaagaaataaaccctcggttctatggaagtcataaggaatattctgcctgtgtgcttgtacaaccttggcttggagcagcggtggatataatgcaagtggctttgcagaatcacggggttttctacaggtcatttcatcacccaggtattaagctgagtactcattagttatttttcctgatactctccctgctcccaccttccaccctcaaggaggtctcagtgtgtgttactctcctctatgtgtcgttgtgttctcgtcctttagctcccacttataagtaaagacattcagtatttgctccagatagttgctggaggctattatccttacaatcttctatattaattacaatggggcatctcctgaatttcagaggaatacttgtttcctgattcctgatgtatatactatcagcatatacataaatacataaatacatggctgtgaaatcacataaagcctttacttccatacttgacttcctgcagaacctccacatttcttatgagcttccatttttctttcttcttggcatttatcattacttaatgagaggtttccaaagtttagagtagtacattaattaccatttctcctcttcctcctcctgctcctcctcctcttcctcctcctcttccctttccccttactctctttctcccccaccttctcctctttcttcctcttcttccttcattatttatttatttatttatttatttctgagacagcattttgctctttcacccaggctagaatgcagtgacaccatcatagcacagtgcagcctcaacctcctaggctcaagcaatcctcctgtcttggccccccaaagtgctgggaatacaggcatgtgccacatgccagactactttttatttttattatcttttttttaagagacagtcgtgctctcttgaccacgctggttttgaactcctgggctcgaccagtcctccttccttgacctcccaaaatgctgagattacaagcatgagtcaccatgcctggccttaaattgtgtatcttctaattgatgtagacttttatgccctatttatttgtgctttgaagtgaactgattctgaatgtcagtgctagagcactgcttagtgtttgggggtggttaggcagatatgcaagttcttagagcataaagctgctcactgctcccagtagaggggctgcaactgtttggagggttttagaatactaccatttgtgagttatgtatgaagttagggaagcctgctactcctgattagactggcaacaactttttgcattataagacaactgaaatttcatgtccaagccaggtgatctgagctacccctgttcattccagatccagggctggtgaggcaaaatggtatccccaaaacagatgggtctctttactgaacttctgggttatctccaccatgtagagaagatatagaatcatgcatttataaactgtatggttgaagatggcacccacagttacatttttctcccaaacttccccggcctatctcagttcttagatatattgtctgaggattcctgattaggcatagagtaatgaggaaattttctccttagatgattatggcaagctgctataggcctgttatttatcctcagttaatatggatattctagtaggagggcacagtaaggtaggaagaaatggtcactctgaattcaaagtatctcttaatttagaaggcaagtttaccactctgaaagtactgagagtctcaaatttcacgtaagcatatttttgagcattttctacaaatcctcatttcttcaaatcccatcctttgcaacctcaagtttatccggaggattcacactgcctgcaagtccttcttgtatgcatttcttgttgtttctgtaacaaattatctcacctgtagtggcttaaaacacacacatttattatatcgccattgtgaagttctgtagtctgagtagcttggatggtttctcttcattgtcgaccaaggctgaattcagtgtgttggcagcagggtagtgtttcttcctccatattccagggatgcgttcacttccagaaacatctgggttgttggctacattcagttccatcaggttgcgggtcctgcttccttgcaggctattgattggctgagggcaaattttggcttcttgaggatcgaagcattccatgactcctggcctccttcctcattcttcaaagcacagcttttaatgttctgaatctctccaactaccttttctacctcttctgtcctttcccttgtcatatggcttgtctgacctgattgttctgtcactgttttcttggttttcagtatcatacaattgtattggacacatttggttattctaggataatcagcttatcttaacatcagctgactagtaaccttaattgtatctgcaaagaccattcataacagtacctagatacatgtttaacttaatagcgaggggaataagaatcttgagtggtgtctttataattctgtttaccacacacccatccgggtggacagactccttacaactgggtttgagtactcagaacaatggccttccatctttactcacccagggagctcctccagggaaagctcatctaagtaagatctcaccatcattttcatgccctttctttttttttttttctttgttgttttgagacagagccttgttgtctctcccagactggagtgaagtgacatgatctcggcccagtgctacctccacctcccaggttcaagcagttctgctgtttcagcctcctgagtagctgggactacaggagtgtgccaccacacctagctaatttttgtacttttaggagagatgaggtttcgccatgttggtcaggctgatctcaaactcctaacctcaggtgatccacctgcctcagactaccaaagttctgaaattatagtcatgagccactgtgcccagcctctcctgatcttttgaagtccaagtaataatcctcaggtggcagtgcacataactgtggagaattaaccactcctctctgatgttgcttgtacccaccgcaaataatttgtctatttatttttacttttattttcattttttgagacagggtctcactctgtcacccaggcttgagtgctgtggtgcaattagagctcactgcagcctcgaccttcttggctcatgtgatcctcccacctcggcttcccaagtagctgggactaaaggtgcatgccaccacccatggttaattttaattttttttcattgatacagaatcttgttcaggcttgtcttagaacttttaggctcaagcagttcttccatctcagactcccaaagtgagccactatgcctggcctatttgtcctttttaatttaaaagactcaacatgtagaaataattttatcccttcaccttgtgcattaagagcttcctttttcttgcagatggctgaactgaagcaccataagtgatgagatgacattttgtatttttacacacattcctgccctttctcagatgagtctaggctttcatcagtatttaaatgctaacttactctggcaagacatttaggtccagaaaatagtttaaaaaaataacatcttcacagaaagaacctccagatagttaaaaataggggaacttgtggatacaccatattctgaacaattagtgttgctaaataaaccacattattttaggtttttcttcctgattttttttttcttccttgtgttactttaattctggaacataactgggcactgataatactacagcagacccttatctcttttctttattatgactggaaatcgtaattagaaagatggataaaaatggaaaagcttaatgacgtatgcatatttttataagacagaaatatggaaagatacgagcaataaaataattcagtttagaataggaagggttataaaacactttttaagcagaaaaggaatcagagaatggcactttataatatagtaattaagcctatttatttgataaaattcaaatgtcatgtcctctttgtacctatgagtgcacattaacagtaaccataaaaaagaatacttggagctacagatatgtgtgtgtgtgtgtgcatctgcacctgtgtctttgggtgtgttccatctgatttgatttttcaccatatctctatttttgcactcccaaatgtaagtatttaagtgtttattatataaaatatttttgcattcttcctcccttcacatgcagtgatttacaaatttcctatctgactatttccatcctgcaaacccccagaatactgtggctgaggtactcctctttctgttcccttctctatataggtggaacatcttctgggaaccatcttccatctataagtttcccattcacagaggtggctaaatctgtagcatgcatccatccatatccaatagtgtctttacatgggtgggttggataatgcaaaaccaagcttcaacgtcaatggtgtgagaagtacacaaacacacacacacaaataaaaacatgcataatctctgtagatcagaaggggattgtccagagttaatattaatgtacactcttaactacaaagaggtcataacatccaaattccgttaagtacattgactaaattactatattataaagctcccattctctaatatcttttgtgctaaaaatattcccaagccatgttgaagatatctttcaacagttatgtttcctaaaaatatgcctagattgttaaatgttcacttcttcatgtgtttttctggttacgattttcagtcataaagatgaaagtgacaagggtctcagcagtgttttacctctaaacctaatactgaccctaacagaaattgaaaccttaaaactaacctgtggcctttgaccattgcttcttgatcattgagctgacccatgaccctgaacagagaatgagaacttgaacccaaattttaatctggaccctaactaatgactggatatgaaacctaattctacccaaccttgaaaatgaatctaaatttagactcaaaaccaaacccaacccaacacctactttaacttcaatgtaaaattttgaactcacccttgacttttgccagtaacccttgactcttgacccctgatttgaacactgaaggcatctaccaaattctctaacccacagacttttgatcctaatcctgacctttgaccattgtccctaataacgaatataatcccttgatcataatattgacttgtgctcctaccctgacattcaattagtgatctaaccataccccaaattgaacttgaagccaaatcctaacatgaacctttatcaatacctgaaacccgtcctaacccttgatctttgatctttaaccctctgtgttttgctccttgactcctgactgtgagatcccagcctggactaaaatccaaacacacactcaacatcattcttgaccagaattgttacccaaacctgaacaggaacccaaacccttaccctacccacttacaaatctgaacacaaaacctctacctattctgaacttggggatttgagtgtctcggtcctgtttggtagatgcggagtttgcaggccttcagtcatggtggacaccacagacttgaagaaactctccaatatattttttgggaaaaaaagatgcaaccatttgagagcaagatgttaaaacattcatcctcaatctctgtttgtacagacttcaaggtgaaatacatgtggttggacttgtgatatttccagccacaaaattgtatcatgtagagataatgtaggtttccctgtctctgaaaatgcatttattcaaccagtacttacttgctccagaagtgcaccagggaccattttaggcccctggaggcagccataagcaaaacttcccagatccctacctatggaatctctgcctatggaatggacattgtcataatggatgtagataagaaatatcctggactcaaatctgaacttcagtcacgctggaagtccaaactcctgcccagacatgttttcctattactcacagaggataggtgaggactcaggttaattaaggtggttatttttgttgccagttttatctaatgtcctttgtggatgatgtgtttttcacttggaataccaacatgagagactgggccacttctcaattcagaaatccactcaaggccaggcatggtggctcacacttgtaatcccagcactttgggagccaaggtgagaggatcgcttgagccaaagagttcgagcccatcctgggcaacctgactaaagcctgtctctacaaaaagaaaaaaaaattagctcagtctggtagcacatgcctgtagtcccagctactcaggaggcttgaggtgggaggatccctaatcccaggatgtcaaggctgctgtgagctatgattgcaccattgcactccagcccaggaaattgatcctgtctccaaaaaaaaaaaaaaaaaaaaaaaaaaaaaaaaaaaaaaaattcaactacatgtagaagagagagagagtgtgtgtgtgtgtgtgtgtgtgtgtgtgtgtgtgtgtgttcattagatttaactgaggatttaaggagaaatttggaggcatattctcatatgggaaaaataggaaaataaaccttctaaaatcaacatctagcccttttgctgatgaccttttggctatcctaacataaacttttcttctgaatgcttcaaatctcaactcagcaaatccacaatgagctataggaaattcacgatctcttcttttctttggatttcacccgccgccattcatgatttaacaaataattctttgaaaggcagttctctttcaaagatgagttttgcttctctgtgttaaaataataaatatgtgtcgctgttaaaatagttttgcatacatgagggaactcctttagaagctttattgggtttcttagctgtgcatgcaatttgaataattactacatagcaattccagtaacatagccaatacatcagaaccctcaggggaggcagccaggaactttcttgcaaaatatcccccacatcttcatccctctctggagaccactggtaaaatttacaatcggtaataatttctacagacatggcaactgagaatggtagaacattagttttaaaaatcattttaataaaatggctttataaatattgagacttaattatttaatttgttccagttaatgaaagatttcatttggcacaagactaggacaaattagaatacgtataattttcttcattccagacaaacaattattttaatgtctactggtacttagaccacaaacttaattcattgatttcatagtattagaaaatatagagtgagaaaattgttagcagggcacagtggctcacgccggtaatcccagcagtttgggaggccgagacgggcagatcacaaggtcaggaaatcgagaccaccctggctaacacggtgaaacctcgactctactaaaaaaacaaacagagaaaaaaaatatatagccgggggtggtggtgcactcctgtaatcccagttgctcaggaggctgagtcagaagaatggcctgaacccgggaggtggaccttgcagtgagcagagatcatgctgcttccccgcagtctgggtgacagagcgagaccccatctcaaaaaaaaaaaaaaaaaaaaaaaaagttagaagttgttgaacagctggatttgacctaaaattactccaagaatgtatcattttttatgcctcaagctgttttgtgcagttctattttcaacttccatagacaattgtaatcttttatttttgttttcttattagagaatgtttcatgatatggatgtgaataattaaatgaacatctttctatgtacagcttgaatttaaattagaacatgatggagatttttggattccctttaattcctgttataaattgtatttctttaaacctgcccaaagggtaaccatctttctgaaaccaattcattatttccttcttttactaaattttatttctacaaaattagcactaccagcttaacctaaagaatatattgtcatctgcttttgttcttttataaatgtcattctgtgtttttcttgacctagcacttcctttttcattgaatggtatgtttttgatattcaaccatgaaaattcttggagctgtagttcatttatgttcactgatatgagaaaccacaccctatggttattccacaagatatttaactctttcagaagctgggtatttgaattggccttatgtaaacagttcaactgttagtattctgtgtatatcttgttgaaaaaaaatgaagtttctctacctagaaatagatttactggactatattttatatccatatttagatatgcatcctgatgtcaagaactgtttaagtggttgaacagttttatttacccaagaaccatatgaaagtttcttgttcttacgttcactatactgagtccaaagttgaatagaaatgaaattagctatctttgatttgttctgtctttagacaaaaggagttttaaaaaaaattttattttgagacagtcttactctgttgccctggctagagtgcagcggcatgatcttgtctcactgcaacctctgcttccggggttcaagcgattctcatgcctcagccccctgagtagctgccactacaggcgttcactaccatgcctggcaaatttttgtattttcagtagagatgggctttcaccatgttggccaggctggtctcgatttcctgacctgaggtgatctgcctacttcagcctccaaaagttctgggatcacaggtatgagccactgcatccagccagacagaagtcttctaatgttttatcattatgtataatatttggagtaggatataaatgaactatctttttcacataaataaatgtttatctccttaatttgataacatgaaaccataaattcattagaggtaatttttttttcatcttttaatattttccttgctttgtgtttaatttgttcatgtagtaaattaaataagttaactttctaatatcaagcttagtttgatattcagtatactctttaatatcatttttgtatttgttatatattaatcatttttgtatctctgtactaaattggataggctgtaattttccttatgttaggcttctctggttttagcctcaacttaatagtagctgtgtagaaatagtaagaaaacatttctgctctctgggagagttcatataaaaaattccttaattaataggtggtagacttgctattcagtccaccctggacagatgatgtctttgatgtagttaaaaacatcttttatttcctgcttgatttgtgggctttattacgtattgatttcttatatatattaataacaacatgtttgcctgtatctgtctgttaacactttattatgttctcttttttcatttgtctgttgtctgtatacattttgttaaactattgtaacaaattatgagaaatgtagtaatgtaaaagagcaaccatgtagtatgtcatggttctaaaggtcagaattcttggtgcagtggagcctagcttggtcctcttcttaaggtcttccatgggtgaaatcaagagactggcagggctgtattcctctctgggggctggagggatgaatctgttacaacatgtagatttttaaaatctaagtatttgcactaacttctgattttaccatattagatccatagggtgaattcctatttcttgatcatttgagtcttagagaagcttgatttccgtcctacaacatcgttagattattacagatttcttatctgctttaaacaaggggtttttctctgttttttgtcaagattaacataatattttcaacatgtattatacttgagttgtatattgtgagtatataagtacacacaatgaacgactcttcagccttaaaaaaggagtaaataagaaataggccggacgcggtggctcacgcctgtaatcccagcactttgggaggccgaggcgggcggatcacgaggtcaggagatcgagaccatcctggctaacacagtgaaaccccgtgtctactaaaaatacaaaaaaattagccgggtgaggtggcgggcgcctgtagtcccaggtacgcgggaggctgaggcaggagaatggcgtgaaccccagagggcggagcttgcagcgagccgtgatggcgccactgcgaggctccatctaaaaaaaaaaaaaaaaaaaaagaaagaaatcatgtaattggtgacaacacagatgtacctgaaggacattatgtgaagtgaaatgagccaggcacataaaaacaaacactgcatgatgaaatgtgaaatctaaagaagtcaaactcacagaaacagagagtagacttgtagttgctataggctggaagttgtgcacatggcgaattttggtcaaagagcataaacagttttttccttcctataatattattttcttaggttctaatttttgagctattgggattttcacatcataattttttggtcttacttatgcttgcatatcttttactactcttgaataattttagtctttctatatcttttggcttaaaatttgtctcaaattggttgcatttttcatctttggttttgttacaaacgtgtgattgtctggaatttttaatttatgagttcaaaacatttatgtttgttgaatattaattttactaaggcttagtttgccatcttgtttgacatgttcaatttagttacttcagaataagcataatataactgtatattttgtctttgaaaacatcagtttccacctgtcatttaatagatatacttctactggatttaaaactatattctgttttttgttcttacactgttgttgatcataactgagcacagatactgctacttattttcccagttttttttgtttttgttttttcttttcttttttttttttttttaaggcggagtctttctctgtcccccaggctggagtgcggtggcgcgatctcagctcactgcaagctctatctcccgggtccacgctatactcctgcctcagcctcccgagtacctgggactacaggtgcctgccaccatgcccggctaatttttagcatttttagtagagacggagtttcaccatgttagccaggatggtctcgatctcctgacctcgtgatctgccggcctaggcctcccatactgctgggattgcaggcctgagccactgcacctggcccttcccagttgtttttataaatttagcaacatactattggtttataccaattgtgtcccatttctatatgaaaatcaaaaatatatagaatacatcaagggatttgttgacagatctgataatttctgtagcagtcctctaacaagacaaacatttttcaaacatgcatctccttttagtcccaccactgaatgccatttaagtagatagttcctagaatttaagttctgggctgttatctatgtataattgttgcattcttttttacccattttagccaaatataaattataaattattgattgtccctgcatttcatatattttccacaattcttatcaaaatactcatattctttcataggtgttttctcaaaaatatttttgagtcattgaaattttgtttagcaaaatgtttgagtccctttttgatcaattttttgtttttactttgcctatactatttgtttctaaacaaaaaatttaaattcacagttatttttcttccaactttcaaatatcactactgtatctgcagatgttctgtgctatcactggaaagtttaatgtcagtctgattcttactcattcatgactcagctatttttttctccgaaggctattataattttgtatttgtctttgacgtccttgaatttcatagcaatatatcaactcagggcactctatgagctcattcaaaataaagtttttgttctgtttgtctgttttaagcatattttcattcattcatcaacttagttctttctgtttttttctctcttacctattattgatatatctaccaaaactgcctttctctcctttattctttcctggtgtttcctatgaatgttcttccatctgatcttccaattcagtaatttgttcttcaattctctctgttctaagatttatcttaactattatgttcttgttcatctttactattacttattccatacttactatatttaccaagttatcttttaattcttattataatctactatttgaaatatattaccttaggtgatcaagtgtattattttgtcttttgtaatttcttcattgatctgttccaataattatatcttatgtagaagagttttcatctgttgagagagatagagtttggtaacttttttaaatattcaggtatataactttttaaaaaaacatttagcctatatcctccttaggtgggtgaaaactcaaccatcagcctgtttgtaattgtggatttgatatgacttaaggccatgcccaagtctatgtttattttacaagattaacattcaaaaatcacttttaggttactctggtgcactgaaaacctgcaaggaaggcttcttatttgaaatgtgcctttaaactctaaatgaactggcattacaaagaggcagcctctttaacatcctttctgggggcatggaggggaaggggctgaagcaggaaaagcccattgtggccatgagtgactggtggccctgtaggtttttagccgactcctcaatgcatctgagtttcccctaggcttaccgaaatcctactacctgatggctgctgtagggttctatgttgtatggagaagagaagatggaagggagattagataatgattaactcaagacatttttgctaagagacaagagtgaacctaagacttttctttcaaactggcatcgttgtgttaccacttccaccctctgccagaaggtttagccacccccatccgccatatatacatggttcttcaggttgtactctctgcagaatggcttatagtttactgcttttatgttctgttattgctctttcagtagatcgatgccttcattttcttagcctctgtagtttctcaaatgtagatttttgtggaggaagcagcattctgttctattcaccatctcaaaagaagcataaatctttttcttgatttattagtatttttcccaacccatcaaataaatctgtacttctaccaccccccagactttgcactgaagaggattgagaaatggtgaaacacttagctattggatagcttttttcattcccacagacctcatcagttattgttagctaatatacccattaagaaaattaccgaggaaacaccacatacatccttattaattcatcacttgtcaaaatccttctaagcacctttcatctatttctaaaaacattccaaatatttcagggacaatttcctaatattttggttttgaatgtcacatagttcatctatcatcatatatgatagctataactacagaaaccaaaatattaactaattcttaatgacaattaggataatgaaggatctattagaattgctctgggtgtctttgattgtcatatgaatttttaaccaaaggcttgtatgagttccagagagcaaacccactacattttccctgccctgacttccagcccatcactatgtagatccattgtggagctttgttactcctttgtagtgtattaaattcgaggatataatatcatctgattatggatgaaagtaatgggacacttactgccatgagagcccctcgtgacaggtgatagttgaaccagaagtttaaagacctgtggcagacaggagggggtaaaacaataggacgcaggacccaggaatacattagggaaggcaacaacagtgaaggaagagctagagtaattgaaaggctgataaacatatttggagccagttctttttatgctatcattaagataaaatcagtaaatcagtaatccttgcctggtggatatttcttctttgcaagaaaaatgttttaactaaaggaagtcatttttgataatttgatttatatacatacatatatcctctgtacaaattgcctccaagcactttggggacaggagaagaggggaaacctgtgagattgatagatgctagatagatagatagataggtagatagatagttaggttagagatataaagatatattctctctatatatatattttttctttgtctctctaaagacatgattaggaaacattctcttgctatatataagtatatatattatatacatacttacatattatatataatttatatataaatgtaatatatattatttgtatcataaatataaatatatttttatatacacattctctctacaaatagaacatatctatcgagagagacatatgcagtatatgtatatgtgtatgtgtatgtatatctaaaacaaagaaacaatataaacacaaaatccaaatgtcaagtggaagaaaactctaatcagctacaagggacaattagaacatctgtaagaataatatgtgtactggatttaaaatgataaagacattaaaatgcatatattcatcatgatacccagaataaaactcactgttaatattactaggcaatgatcacattctcctggatcttgatcaataaaaattatgatttttcctacatttggaataaatactgaatttcacaataactaaaaaattgatgattacaagtaaaattccagataatatatgcaggaaaaacaatagtataagaaaatcattattttgtgaaaccccaaattaagctaagtgtgtgagtctgttctcacactgccaaaagaactgcccgagactggctaatttataaaagaaagaggtttaattgactcacagttctgcaaggctgggaaggcttccagaaactttcaatcaaggcagaaagggaagcaaacatgtccttcttcacatggtgccaggagagagaaatcaggtatacattataatttattcctcctgttttttttttgtttgttttttgtttgtttatattttccaaaaataagaggccatatccaacacagtgaagcaaaatgaacaaagacgttcaaatactgaagttgagcataaatttgacttcacaatttctgtcagatgaaccaaaaaaaaaaaaaaaaaaaaagagagagagagagaaacatttgattctgggatttttatttccagaaagagaaagtttttctctttttcttctgattattgattaagagtagttatgaagttggagataaaaggagaagatggcaatgattgttccttgttctttctttctgcagtggctgtcagcttcactgatgatattaagaataacacagcaaagcctgactgcctccctaaagacagatacttccattacgtgtggcggtacccttcactcctgaatctagaaaatactacttgggccatgttaagtttattcttaaaagcctaacattgtgtagctacagctgcccaacaaatctgcccaaagcactgttcccccaattgtgaatatgcatacaaataacttttcagttttcatgcctactcctggatcataccaccagacattctgatttggaggtcgactgtggagcctatgcaatttaaaattttacagactacccaaggttatgtgaatatatcccgagatagcacagccttcccaggctgttggtgccataaggacttggagagatcaccctcgcttacccacaaacaacttgcaggactaagaagagtgcttaatgaatatgtgttcaaaaaataaaggaatgcacctgtgcttggagatacctggagagctctctctctctctctcttcatctcccctctgtatctctcactctttctctggctctcgttcactctttctctctctctctgattcatttgctatgccgctgagtcatacagtgagaagcagcttaaggtcattaaaaggttgaagcatcatgggaaaaagtgaacatgttttcatttgaatctctatttttaactctttctgaacttgagactgttgcagtgataatgaaataagcctatggtggttcttggaaatcattttagacacacaaatttctaacatatatagagataatatgtaagatcacattatatataaagtcacatagagtaagtataatatataatcatatataattataaaaaattacatataaaagtatattatatatcatacttatatattcatattatataaatatataatatatattaattatctataattttaaatatatttaaatttaaataaatttaaattaaaatataatttaaatataaattatatatgtaattatatattatacattatattatatataaaatatatttcatattatggaaatatattttatatattacatattatatataatatataaaattgtatattatataaaaatatatatcatatataaaatataatgtataattatatatacttcattatataatatgaaattattatatgtaatacacactatatatggtatataatatataacataatttaaatataaattttatataatatataattttatagaatacattatatactataagtatataattattttacatataatatattatatataaaatataatataatatgtattgtatatatttatataatattttatatatagaacataatataaatttgtatatgatgtatatcatatagtatatgtaattattatatctagtttatgctatattgtatgtaattatatataaaatataattttaaatataaactctatatgatataatttatatattataatatatgattagataatatataataagtatatatacttaatatatgtgatcttgttaagtataatacatatattatatataatatatattatatgtatataaaatatattaaacttaccatatatgatcttgtttgacatgtctttttgtatagaaaagcacttaaattacccctacttcagcaatgaggatgttgtgtttaggccaaaaggcaatataaacacaacttgctattaaagttttttcttaatcatcactaccactgaaccattaataagtattttcctgcacaagataataatagcatctcacatttccatggtactttataatgcctgaagctcttccacattcataattttgttcatgtcatagaaagaatgagctttagtaacctcttccatttaaggggatcacagaatgagtaaaagcctagggtgcagttagaaaagaactaggtttcagtcatctagacatggttctaggactcttgaatgcatgtgtaactcaggctgaaaatcccggaagatacatccccatcccaagagcacctacacaatttcaataacctggttacaactgatgcactttggatattgcactcttcacaaacatctatccaaatctaacatgaactcacatcagaacaactatcgaatccccactcctaccaaatattcacgtctggtattaccaccaaagcctgaagcaccctgacaacatgtgtccagatgttgttgaattttttccatcctgactgcctctcaccgaaagccagaaccaacttgctcctggatgactgcagtggacttcttccaaaggcagcctcctgcagtcacatccatcagtgcctcttatggacttcacaaaaccataaattctatcacatactgctatcttcccattcttatgtcttgtcattgttttataataaattccaacattttagtcacttttccaagtgtgaagtcatttatgcctaccactgtaataccattctttcacatttccttagtcatgatgagtcagttacactgggaatccttctgttctcctcaccctttaaagttccttttggaactttgaaacttataattcttttcaggaatgtttccctcttaacatcttgtggctgcttccctgtcatcatttccttccatttctaccttttcagagaggctttgtttagaagaaaatataggagcaaatctttgccagctaggcttatgaaaagttttcttacatagaacacaaaatacaagaactgtaagagaatgtattgattatgaggacttcaaggcaccacgaagaactcagacaaaaagcttcagattcagacaaaacatttgtaactaatagagcagagaattgacttgcatcttgaatatatataaatatctcccaactcaattgttaggcaagcgccctatagagcagcactcctgaacatttttgacatcagggactggtttcacataagtcaattttcccatgtcggtggatggtttctgggtgaaaatgttccacctcaaatcactaggaattacattctcatcaataagcacacaacctacatccctcgcatgtgccgtctcaataggatttccgctcctatgagaatataatgtcaccacttaactaacaggagatggagctcaggcagtcatttgggtgatgaggattggctgtaaatacagaggaagctttgctaggttgcctgcaactcccctcctgctgacccagttcctaaaaggccatggaccaggctttggtggtaatacaagatgtgaatgtgtggtaggagtggggattcaatggttgttctgacgtgtgttcatgttagacttggatacatgtttgtgaagagtgcaatatccaacgtgtgttggttgtatctggtccagtactggaccatagcctggggattggggatccctgctgtagaggacagaataacaaacccctatgtatgttcacatcctacgttttgtggcaagaaggtcttaagtgatgtgataaaagactttaagatggggacagcatcctcaagtatctaggtgagctcaatgtaatagaaatatccttataaaacagaaactgaaactttgaaacaatagaaaatctgaaggtgaaacagaggtcaaatagagattaaggtgctgtgctactggctattaacgtggaagaggggtccatgtgttggaagcctctaaaaggtgggagaaacaaggaaatagttccacaattgtacgctgcagaaggtaccagcactgaagaagcattttagacctctgatttccaaaactatcagatactaagtatgtgttgggttaagccaccaagtttgtgtatgttatggcaacaactaagaaacacatacatcacattatttaacctttgcttgtaaacaatttgtctctccatgctggagggtgaatctcctgatatcaaagatcctgtttgtattgttcattgtctgtgtcttcaacactaaggacaaaacatgactagcatattttgagcattcatgtagacctgttaaatgaacacatggaataatctcaaatgcctgctaagtattttatctcaatttcatcttgttatattaaaacctgtggtcagctgtggtggctcacgcctgtaatcccagctatctgggaggccaaggcgagaggatcaagaggttaggagattgagactatcctgactaacacggtgaaaccccgtctttactaaaaatacacacacaaaaaaatttagctgggcatggtggcaggcgcctgtagtgccagctactcaggagactgaggccggagaatgacatgaacccgggaggtagaggtgcagtgagctgagctcatgccactgcactgcagcctgggcaaccatgcgagactctgcctcaaaaacaaaaacaaaaacaaaaaacaaacagaaatattaacaaaaacaaacaacaacaaataaaaacctgtgcttttttcccaacaattaacttcaactcttaatcatcattcttttgccttgggggataatataaggttaattatattttgtaaaacacaagagtcatgaacaaaatctaatggaccatacatagcctccatgtgctgtctactcatgatgcagtgtttcaaatataaaacatatatatagtatatatgtatacatacatatatacattcaacaagcaaacaatatatatattaccctggagaactgctttgttgaagcctataaaagtttgtgtgtggagcttataaaattgagtgtgataaaagttggaaaattgagataaagtggagaattgttactgtgatagttgcttaaaatctagtttttagaacaacactaagtttgaccatagctgctctggtatgtgatccatttaatgtttttgcttttgtacattaattatcagagagatatcttagcctgagatatttaaatctgttagtgaataaagacttccatgcaacaccgagacagagttatcaaaaatgacaaatccttgacaattatagtaacaaactttagtacagtaagagatataataggacactgtaactgctctcagatcaaacatccctcctgcttagagaaaaaaaaaaattgcacttagtgcaaatagaattgcaccaatttctctgatacagcctgaaaattaagccaacatttcaggtcttgtaagaaaagttgctgtcttctggcttagaaaaggcatcccaggtagtggctgaccattaaaaggaagatgagcgttatgaggtagccatcttcaaaaagaaaaatggcaaagactttacaaaaccttaatgttacaatgtataaaaatagtataaataagtaagaacttaaagagacagagagtgcggttaaagcagcaagccagtaggacaattttagtgtatagcttaaggtacaatatatgcataatttgcccttccttaattctagaaaatattgtctgtcttcttcaataacctttctattaatgaaactaaacattccactgggattttagctcttttttatgctgtcatatttactttgctactgtatgtgattacaactaacttctaatttgtctaatatatgtgatattttatctagtatttcattcatttaatatgaattttaattaatctaatataatattgtaaaagtctttttcttatatgtattttatagtgccttttatatgtgttttatctccatactttgatggtgaaaacttactttcaattcaagtgttttaaaatactctcattaaaaacaaatggaaatataaatgaaaaaaaaacatttctgtaacttttcaaagtatatatggaaatgcactcaactgtggcaacattttcccccaggtttagcatattgcttggatgattatggctacttcatacatgtttgttgaatgagaatttttcataaattttatagtgtatgtaaaagctatggtatgttttttgtcttgtctttctcttttggctttaaacacatagtggctaaacacagagcaggctgaataaatacatcccccctttatgcaaaattattcactaataaatggtatctagttcattctttaaaataccataagagaacacataatatctctttaccatttgcaaaattttgaagtcagagtctaatttgaccagcagtcgattttaccctttggactcgtttaatttatttgaagaacatttatttgttcctcatgtgtgcaggtgaagcaaaactaaagagcatggcttctgatcttcatggaagcaggctagtaggcagctattttttgtttgctttttgagatggagtttttttttcttgtcactcaggctggaatgcaatggcatgatctccgcacactacaatttctcctcccaggtccaagtgattctcatgcatcagatccccgagtagctggggttacaggcatgcaccaccacacccagctaatttttgcctttttagtagagattgggtttcaccatgttggccaggcagaccttgacctcctgacctcaggtgaactgcctgccttggcaaccatttttgaacatattccacatgaggcaccatgctgtttcttgtacattgtccagttgagttcctcagctttctatgtgaggactactattctcctccctttttcacatgtaaagaaagctgggctttgaaatcttaaataacatgtttgaggccttacaatagattacaccccaaaggtgtcagactgaatccattgaatcaataactctgacagcaattacaaagcaaatgacctttgtgtaacatggtatattctataacagaaattcattgaatgccatttagtgtgctgagacaatacagataatcacacaggacacttctggaaagaggtctacattggtagaaagacttggccaggtcctacctgattatgtaggtgactcctgcagaagatgcagagcctgcccttcaggtcacactgacctttcaagtggtgctgtgtccatgagctagccatgcagcttttttatatggccatagccacaggaagggatgctcaggcaaggtgttcaaggcaattaaaggctgcagaggccaccttagatcttgaggacttcatataaaaaagcaagcatttcaaaatccaaggcatattctggaagtagttagcaagtatagtggtggatttgcaagctcaagaacataagtagggcatcccttgagaaggtcacatgggcccacacaggatgacccttggattcccagtaatgaatttgtgtgtccagtacactcattatattgtgtgtgaatgtgattgctaaaaaagaagatataaattgtgaacaaaatataaacagttattagcaataaaacatgaacatttcctataaccacctcctttgagataatcactctccactgtttgaattccttccacattttattttttaataaaataaatgggccacgcaaagtggctcatgctggtaatcccagcacttcaggagacagaggcaggtggatcacttgaggtcggaagtttgagaccagcctggacaacatggcaacgtctctgcaaaaaatacaaaaattagcccacacgtggtggcacatgcctgtaatcccacctatttgggggactgaggcaggagaattgcttgaatccaggaggtggtggttgtagtgacccaagattgtgccactgcacttcagcctggtcgaggctctgtggcaaaaaaacaaaaaacaaaaaacaaaacaaaacaaaaccctaaaaaatataataaaatacaataaaaagtatttagcagcccactattttttttttttttcagatggagtctcactccgtcaccgaggctggagtgcagtcacatgatcttttctcacggcaacctctgccacccaggttcaagcaattatcctgcctcagcctcccaagtagctgggattacaggcagcccactatttttattgagacaccatagatgtgttcctgtctccatgcatgtaaatactccttaacacttcatgcaaacaaacagcatcccataatatggatgcaggcaagagaatccactcaagtcactgatttgtgaacactgagcttgctgctattgtttgtttttaaaattacaatccatgtgaattgcagagccttgggtggttatttttatgcatcagaataaagattttcatagaaaaaccattcaaagcattaggactcctaggtcagaagtctccaattttaattttcctgggttttactcatcctcttacattggacagcatcatgattattttgatagtgcagaaattcagagaaagctgaaaggacataaaacccaagtgggtaggtcctggaggactgtggttctcatctcaggcactaggatgcagacccagggaggaacaagatgtacaagctttttgaaaaataaaaccaaaaggatgtgacagccaattgaatgagagtcatagcaaatctggagatatatttaaggagaaactgctcagttaaaaagattcaaagttgtctgggtgtgatggctcatgcctgtaatcccagcagatcacttgagctcaggagtttgagaccaacctggccaacatggcaaaaccagatctctactgaaaatataaaaattagtcaggcatggtggtgtgcgcctataatcccagctgctcgggaggctgaggcaagataatcacttgaatttgggacatagaggttacagtgggccgaaatcatggcactgcactccatcctgggcaacagagtgagagagtctatctaaaaaaaaaaaagactcaaagttgactcaaagagaattgtttccaggcaggccattctcaaattttcatttccatgaaactcatatatcaattatcttcaagttttgatatattattgtttattaagcaaactgtatttattattttatattttgctcagaaaatatccatcttggttttttttattttatgtaattgaaactaaagcacttaaaaaagcttatgcagcttcattatagatacatgtaggtggacattacctactttatgaaaatgatgcaaggaatctgaataagagtttgtgggccccagagtttggaaatctgtggtataaataccatgtgtctgttataattgtcttagattttctctatggactttggaaactaaattttggctctgtgaaataatgatatgataacatgatacaataggaaaatagtctgctagtactcattccatttttaagtaaagtaaaaactaaaaatcaaaggcactgaatttcaaccagccttacctatcaagctacagaatttgagtgcaggacgtcacgttccctcccatccagcacactctgtatatgtatgtgctcctgtgttgaatcctacacaatttaaaacagaaaactgaagcctcaccttttaataaattgactatgaatgatttcctataaccatcaaagattagtttttaatctatttgactgatttttattttttatacctctgccttcattctcaccagatttctctttgaccacagttgtgtgacctaaaacaaattctgtttgttctcactgaataatttttatttaaacttttcctgtttggtgtcacttctttagtttaaaggtgcacatatgtgtgtctgtgtacatatacattcatacccatacattcatatatatggttatatatgcatattgtatgtatgcgccagctacaggtaaatgacacacacggaaatggtcaaagatatttaacttctctattcacataattatcttctggttacttgtctccaaaaaatgcctagtgtgtttatacgaggaatgatctcataaaagaaagtggattatggctttaatgtcatataacaatgtcttttgttaattaaaaggccaacaatatctgaccccatttggttccttaccattgacttggagggcatgcagaaacaaaagacctgcaattattctcctaagccttgtgatataattcaaaaggagaggaaacatctacattattatttataataaaaagtggaaacttttctattctaccaacaatattaagcccaactagaaatcctcatgtttatatgatactcattttagtcaacatgcagaaggaaaaactgattcctgttttacggcacctttaccatgaaacatgtttttaaataaccacactaactgaatgtattagtctgttctcatgatgttaataaagatattcctgagactgggtaatttataaagaaaacagatttaatggattcacagtttcacatcgatggggaggcctaacaatcatggcagaaagtaaaagaggagcaaagtcatgtcttacgtggtggcaggcaagagagcatgtgcaggggaactgtccttcataaaatcatcaaatcttgactatgaaaatagcatgggaaaaattcacgcccaagattaagttacctcctggtgggtccctaccactatgggatctacaattcaagatgagatttgcctggggacacagcaaaatcatatcactgaaaatattgattgatatttcttgtgtgtatatttttgttgtcgatgttccttccagagccctggatgaaacttggcatcaatgtagccattaacatgcattaattctacatgatctcttttgcatctttcttttgttgttcagttggtagaggagaggttgctgatttacaagcttcattttagggagagtaaaacttaaaagccaaaatttcatcagctaacaggcttagagtatggagcctaaaggacctgtcgatgaaggaggttattcgttgcatatctgtggttttagacaatcaagggggttgtttttttcattcacctggaatgtgtatttaaagttaagtgatctacctgagagctgagttctcaagaagagcactcatctttgatattatgcatggctctctccaagttgatgaggtaccatcattttgctctctacaatcaggaggcaaaacccagtgatttaggtgtgcaggattcctaaaatattaattttaacttgctacaaaaaatagcagggtttctggtgtctgaaaacttttgagaaatcacaccattagaatattgttaagatcactctttatttgcacttaagaagataactttgtcaggaaaattttctttcttcctatcttccttccttccttccctccttccttccttccttccttcctccctccttccctccttcccttccctcccaccttccctctccctgctccatcacataatatagctataatgtgctgccttttcctctcctccagtgttattgataggaaaaactggccaggtactgatgaataaagaaaaagacaaatttatagtgagatctgattgtcacagatcaggtgccttatgaaaacaggtcattttcttcttcaaacaataactttctgagctcagaatttcatgacaataagcccacatgcttcttaagtctcatttatataaaatgtgatttagacctcagaacactgtaactgcccaacagactcatctttactacacagatagagctgattagtcaagatagaagaattgcaataaacagtttaattcctacagagctggctaaataagtgattggagttttattattacctaaatcagccttccccaaaattcgaaggcttgagtttttcaaggatagtttggcatttaggggctagggaatgagtgctgctggattggttgggatgcaattatagtgttttggaaaacaaccctggtgcactaagtcaccctctacatggggatacagagatgttaatggtcccagtgggaccaatcaattgtcgcaaataaaagcctgaaaaggcatctcaaaaggccaatctgtactattcttatcacctgagtaacaacaattcaagatgagatttgggtggggacacagccaaatcatatcaccgaaaatatctattgatatttcttgtgtgtatatttttgtggttgttgttccttccagagccctggatgaaatttggcaacaatgtatccattaacatgcattaattctacatgatctcttttgcatctttcttttgttattcaattgaaagaggagaggttgctgatttacaagcttcatttcagggagagtaaaacttaaaagccaaaatttcatcagctaacatgcttagagtatggagcctaaaggacctgtcagtgaaaggtcctgtcacatgaaatttacctacataataaacctatagttgtacccccaaacctaaaataaaaggtttttaaaggccaattttagtttctagtgattggggaagttgcagatcttgtcacctatggaattgtgtctggagtttgttccttctggtgggttcatggtctcactgacttcaggaaccaagtttccactcgacccaggaagtccacctggcttcacataccaatagaaggtgtctcctctaaactggacaccccaaatgctattgggaattgggtgatgaccgctctacctacttcctgatggataggggcaaagaagtggccctgcagttgtaatgtccttcagaggggaactctctagcccagtcttggagccacaaggtcgattcaggggtcctcagtagaagttgtgagttgagctcatttggggttccatttgtaagaccatctgtagcttgatggcctcgatcctggaggaaacaaatttgacaaggagattaaaaatacagggcccaaatgcaagtaatagcaagatggctgtcacaggacctagaaaggggagaagccatgtcactcaacttcagatgttggtataagagtttgagaggcattgtctgatttcacaagtcttttcctgtaaacactggatggcatctcatattatccctgactggttaatataaaaacaacactcttcccctaagaaggtgcagagtcctcctttctcagcagtgaggaggtctaggcctcagtagttttggagagtcactgctgccaaagagtctacttgggattgcagtgtaaggaaagattttgttatttcttgaaaactgtctgagaaatacttttagagtgtgtgataggtagtaggataatggagtagataaactggctattctgtttcctgtatcagtggccattcctaaaactataagtagggttattagttgcatggccctgcactgacgaacttgaactttaaggggcactgatagggtctgatttcctggggaaatgtcagtgttgggacttaggaagactaagttccaggtgcctgtccaggtggggaggcagacgtaggttcaagttccacataagaagaacatgccttggctgagtagacagaactggttgtatatgttaaaaaggcttgtgataataataataactcatattattttcattttcccatactcctagagtacttgccaaggtacctccagagaatagctgaaaaggagtgttgggagaaaactgagtggctccctgtgttctattttcccattggagaaaaaaccgttttgtatctactaggaaccattcaagacagtgatagaaagagggaatgagaaggctttcattagtggtggggatgctgctgcaaggggtccagggatgaatggtcatgcagggagaatgtttgccattacaacacccagactgttaagcaggtaggaggtgataatttttggaggccctgagaagcagacaagccatctgaatggagctgtatgggtgactcacaagttgctatgatctgttggtggttgaagttgtagagtattattacactgatggcattgtaggtttccaggggcaggcctgataacagattgcactggatgcataaagaggcttgaaaagttaagatggtattcgtggttacagggccatatatgggcttttcattgctagtgtaataggtgaaagtggaaatgtaagagtgtaaaagctggattccatgtcctgttagggtattcttggtaagctttgtgataacccaaatctaggaattatttcatgaattaggactttaaccacttcctgagcattctctgtcttgcaggggaaggcttctatcaaatttctaaagatatcagcacagaccaacaagtattgaaatccctttaacttaggcataggcatgaactctaaataccagtcctgcccaggatagtgccctattctttcttctcccagaggggccttatgatagaccatggggttttttctttggcacacatcacaggctttgactacttgtcagatgatctagaggagacatgtccttgtaaatagggatttggctatttgatgagtgttctcaatacacatatggagagtttggtggaggcttttaagtattttccactggctggcttcaggtatgagtacctttcccttttctgtcattaaccacccctagcatagaaaactatacccccgtgaaattttccattctgtttcatttggggaatactggggcttaatctcttggagagggttgttccataccaagggtccttccacaggtacttctaatgggaggttccgcctggtagcaattttggcctcagagtctgcctgacagtttctaccttttctccttcatctttttaatggctttggcagcacaagactgccacccccttggtttttgcactgtgtgcaataactccatgatttccttgtggcatttaatgggggttcccccagaagttaggaactccctttttcttcatattgtagcattggcttgtagggttagataagcatagtttctacctatatacacatttattatttttgcttttcccatttctaaggctcgggtaagcaccagtagttctgctaactgggtgctgatccctgggtgaagagggttacttttcaaatactgttacatcactatggcataacctgccccttcatctcccattctccacaaacgaacttccatcgttctataggttaaggtcaggattagctaaggggacttcttagagatcctcttgggtgacacagtctgggctacaatttgttggcagtcatgctagatcggtcccatgctatgggagaaaagtcgcagggttgagggctgcacatgtgcatacttgaagcaaagtctcaaggagtagcacctggtatctaagcaggtggttatctgatagccataaacttcctttggcacctagtgtgccatttacatcatgagtagtccagacagtgagatcctttccttgtattattttgatagcctctgacactaagatggccaccactgcaactacccgttaacagtgaggccagccttttgctactacataaatttccttacttaggtatgctgctggttgtggggacacttagtgcgtctgaataaggactccaagagctatttccactctttctgtgatgtataaaaataatttttttcatgtacgaaggcttaaggctacagcttgtactagggcctgctttaaggttttgaaaactgtttctgcctctggtttccattccactagatgagtatttgccctctgggtgtccttgattaaagtatagagtggcctggccatctcgccgtatccagggatccatagttggcaaaactggtgatcccaaggaacgtctgcaactgtttaaatttcttagggcaaaggataagccagtatgggctgcatttattctttgctgagggttcctctggttaaaattaggcctggatatttgaattgttgtaggcagagctggccttcaattagatgccttttaccattgattagctagaaacttcaagagatctatagtagactgctggcatgtggcttccaaactggtagcgaaaagtaaatcatccacattctcaaggaccagtgtacctggacttgagaagtgacctagatctgggatagcacctgaccaaacagatgagggctatccctaaatgcttgaggtaagaccgtccatgtaagttgggatgtgtggtctgtgggatcctcaaaggtaaagagaaactaggagttagagtgcaggggaatggagaagaaggcatccttgaggtccagaacagtgaacaattctttttcctctgttgagagtgtagaggtataggtcttgggtgcacctggatatagatgaatttctgcctcattgatgaatctaagatcttgcactagtctccactaacaattcggtttttgtactcctagaattggagtgttgtagagactgctgcattttcttgctaagccttgagattttagatgtctaacaatatcctataattgtttatgagcttcagaccttaagggatattgcctttgataaggaaaattggtggggtctttcagcctgatttggacagggccaacattttttgcccttccgaactgtccttacaatgcccagactccagggttgattccctcctcaagcagtggacaacagataagtgacttgttccccatattcatatggataatagctccagctttggctaatatgtcccttcctaataagggtgtgggactttgaggcataacaagaaaggcatgtgaaaagagcaaagtctcccaattacaactgaggagctgggagaaatgcctggttacaggctgccccaggattcctcagatggtaatggaccttcagagcagccatctgtggcaggatattaacactgagaaggccacatccatgtccagaaggaagtcaatgtcctggtcctcaatggttaaatgtacctggggctcagtgagggggacaaaatgagctggtgctttccacaggcaccctcagtcctgctgttggatcacctggttggggactgctggtcctgagaacctttgtcctctggggcagtgtgctttccagtgatgaccttggcatagtggacatggccaagggggtgacttgtttctcactggacaatcttttctaaggtgtccttgaaaaccacactaataacaacccctaccaggtaattggtctgatccattttctgtcctctctgaagcaccaaggtttgtttgactgagggccatgactgtggcctttcactgatctcccttttccttttgggcctgttcctcttggtctctattatagaacaccaaatttgccaggtttaataatgcctccagattttgttcggggccagggctcacttttggagctttatcctgatatctgcagctgattggatatgtgttaggatcaattgaccctcgagggagttggttgacaggggaatatattttcttaaggcctcttgtagctgctcaaggaaggcagtaggattattttcctttccctgagttatggtggacatcattgattaattcatgggctttttcctattctccttagtccttctagaacacaggtcaacagatgtttgtgactccagtccccacgatctgagtctagatcccagtggggatccatatgggttacagcttgctgaccagtagggaatttgtccctttcttcggctgttattctatcatttacttaactaaaataccagatctccaaacactcaggctgtagctaaagccactttattttcactaaaggccagggtttgatctaacaatagcatgatatctttccaagtgaagtcaaatatttgccctggaccctgtaggacatctatatacctattcaggactatctgaaaacatccccaggtctaccttatctgctttaaattggagagggagaaggggacatgtacctaggttcagtcaaattcccctcccctgacagcttgaaggggacataagccatagcctgggggtgtttgtggtcccttggatatttctttgcttgttccccttctgggtgggggagactagaggaggcttattactgataggaaagggagctgtatagatggtaggatatgaagctaaactgagaggtcctcctgtggaatgtaaatttcaagctttgccttgttgtggattatccttcaatgaaaagaaagcttagacataagatatttcactcaatttgccttctctcttacaggtcaaaggacagtatggcattctaatttatacttccctcaggtggtcatttttcccatcagagagagaatattgaggccaggccatagtgcagaaaaaaaaataagccacttctatttcagtgtttgcagatcaaattgttcccaatggcttaggatgcatttcaagggtgagcttgttgatgcctgagtgattcccatctaaaagaaaaaaacaaatgtggttttggtttgccttttttccttgcccaagatcctgcaacagtccctggaccctgatgttccgaatagttgtgctcgccaaagcagcagcagaaacactagttttcctcctagatcataaggaggaccaataaatgtcggatttagtagcccttaccaacacattcttgaaaatcaacacccttgcctttcctcttagaccacaaagaggactgagaaaaatcagatttagtggcccttagtgatgcatccttaaaaatctgtaagagtcctaagcattctcctcttagtattgggaccttatccttgtcctataaagatgatatgcatcaaaatggagtggagggccatacccttagggagggaagggatctccagggttggaagagtgacaccttttgtcctcacttctcatcaatgaaaaggaaggatataatttctgaggctccccttatcctagcttcaggaatagcctttgttaggcctgctagtctgaggagggttgataaattccagatcatccccctcccaacaaagcttcaggtgaaaactatgtttttctgataggggagcctgggtacctaaagaaggaacagagtcccacagtttataccataaatcatttataggagaaactagaagatcaccagggacagggagttgtttttagacacagggctaccttcagagaagagaggcagtaggaaaggttgtcttacaggcgttaggacccagaaggcaagggtcacgatagataggatagatgggcgagtctcgcttgtgcaacataactttgaaagttatgctcatggctgcagggtcaaccaactttttgttgggaccctggagctgaatgactttcctctctgtcaacccttggctcagccaagaaatgcaggaaaaatggaagctggttccaggcaaatcaatgctcccaactccaaagattcagtggttgttagagagccctttcccagaaagcctgacacctgagtctttagtccagcagccacgctagttgcttttaactggtcaacaggtgcctggtatttagtccccgaattctaaagaaaaataggacagaatagcaagtgaaaagggtccagcggtactcaccacatggcaatatcctggatgagccactagatgtgtccagagttggttcctgccagtgggttcgtggtcttgctgacttcatgaatgaagctgctgaccttcactgtgagtgttacagatcttaaaggtggcatggactcaaagagtgagcagcagcaagatttactgtgaagagtgaaagaacaaagcttccacagaatggaagaggaccctagtgggttgccactgctggctgagttggccaacttttattttcttatttgtcccatcccatgttgtctgtctgtcctatcagaatgccctttttacaatcctccttgtgattaactacttttaggttattatagagtgcagatttgtgcattttacagagtgctgattggtgcattttacaatcctcttgctagctacagagtgctgattggtgtttttacagagcactgattgttgcattttacaatccccttactaactacagagcgctgattggtgcattttacaatcctcgctaaagagtgcttattggtgtgctttacaattctcttgtaagactgaaaagttctccaagtccccactcgacccaggatgtccacctaggttcacctttcagataatgtttggtaattatttaactaagccaacatcttagcagaattcaggcatctgtcatttttctaacctgctggtctttcattagttttacaaaggttgtttagttttaagaagggctattatcatttaaactataagttcaatttctcccaaagttagcttggcctatgctcagcaatgatcattgtagtatggtggtgaaagacaagatggtgttggttaggtcagatctctttcactgtcataattttctcacagttacaagttttgcaaaggtggtttcaagatgaaaggagtatactcttgtaaagagcgtaaaattatttcagtcattctgtacctgaaacaggcactccccctttttgatagtttaaatttaaaaagaaaattaataatccctggatgttgcagtaaatgaaaattccaatgcagaaactgtgaaaacacatgcttcaaaacaccacattcttttgttaaacttcagagatgcaagcattgccatttcccttggcaagcttacagaatatttggaggaaattctgaacctcaaagatcaatccatccagtaggatgctgtttgaataactaagatttttgaacacaagggacattcattagcctgctattggaaaggttacaaaaacccttgttttgtaagggaggaagggattgtggtggaagaaaggccagtgattcacagcatgttgaaaatcttcacgatcctctgcagaaacaaaataagccaacagatcattctgcagaattgtgaaagagagaacagtgagttaagaaaagatgtgctgaagacagaatcattctgttagaaaattactcgtgccttaaaaattaattacctctctctttaataggggacgaaagcattgccctgtggtattagagggcacccacactgacattattcatcattgtcatatgtaccctgaatgaaaggatttcttctcccaggcaaagcctgatgctctttatgaacaaaccgtgtcaaagatttagtgatggagactggtgttgcagaacatttttggcataaagcactaattagtaatcactaattaaatggtggggggcttgcgtaatgtctgaacatacccactaatcacagctaatctcacatcaagtttctctgaactttaaagaaatcacattggtaggatgtgtcttaagtaagaccaacctcacagttgcaatactgcctctccttgaagctgcaggcaatggtgactcctgatttaggcttggaatttattgtcattgtaggaaaaaaaaaatcttatgactttctttgaagcctggccatttcctcctttccagctcagagcatttttccaattgttcacgaaacctaatggaagaaaatctggttaactctactggtatgcagcctcatcctctactctttttgttttaaaagtagaagccaacactcagtctctcattggaatgctgtcaactttggttaggaatatgctttgaagtagttggtttggatttatgttattttagggcttaaagcagtctgtcatcatacaaacaagcccctcccttatgtgacactgttgttcataaaaggcatcagactttgctcgggagaaatgctcaactaaggacaggaaaatggtaaaaaacaacaacgcaagaaaccttccccaaatactcaactataatatttgttccttacatacaatttctttttttgaagatctacgtcattaactcatttgaagggacatttagtacgtaatttatcataggagtctgttgtgtttaaagaaaaatgtgcacacaaatggtaccttgaacctcgtaaaatttacaatgacttctgggattgcttcatgttattaatattttagattcattttgtcttctattagccacatatatacccaaagatgacaaggtatcataatgtcaacttaacaataatcattgtttatgtaattatttctgccacaaaaatttttctctagttttttctttaatttcctgtaatttccactaacactgtagatgcatttttccttctacattagccacatatatacccaaagatgacatggtatcataaggtgaatgtaaacaataatcattatttgtataattatttctgccacaaaaattgttctccaggtttttctctaatttcctataatttccactaacattttagatttattttgccttctacattagccatatatacctaaagatgacatggtatcataatgtcaacctaaacaataactattatctatgtaattatttctgccacaaaaaattttctacagtttttcctctaatttgtgggggacagggttgtggagagagagaatgaagaaggcaagctatgagataacttttcaaatggtggggatgtgtacacaatttttttgaccaacaaaaatgtcctgtgttcttctgtagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtaataatggtgtccccggggtgggtgggcaaatgccctgaaccaagaaatgaatagtcagagttcatagctgagattcatgtccaggttgccagaagtcactgtggaaattgcaacagaaaatgcccaaaagacaaaatgaacccatcttcatatattttaactcagctttttttccatttgctctgtcactcaggctggagtgcagaggcatgatcatagctcattgcagcctccaactcctgagcttaagccttctccaatctcaacctgctgaatacctgggactaatggttaaattttaatttttatttttatagagaagtggtcttgctatgtttgctcagggtggtctcaaactcctagcctcaagtgatcctcctcccttggcctctcaaactgctgaggtgacagaattgagccaccatgcttggttagcaatatctcctcatttaagtgtgtgacaattaggtgtcggttacaatgataggaaaaaaataactgctttagaagggcggacactattgtttcttttgacagtctcactgtatttgaacatttgaaattttattaacttctagctacaatttggtaagagtaatatggaagagagacagtacgtcaataaggaagagaaatagtatgtcaatattgcagatttatagatttttaatcaactgggcttttaaccacgtgtttttttaaaagacacttctctaattcacattaattctttaaatcttctggaaacattaggaacatggctggtgcattcatagagaagtagattctacccataggaatagtgtctctctccctgactctgtctccctccctctctctcttcccctttcactctcctctttccctctctcttcctgtctctccctctctatgtcctctcactttctctctgtctctctctctgttttcctctgtctctcgcccttcctctctcccctccttccactgtctctcctcgatctccctctccctcacactatcctctcacctctttctccttttctccccttctctctttgtctctcttcctctctctccctctccagttccccagtttcttcctcactgtctctcttcctctctcacttcccccccttcacactctgtctctctccctttatttctttctctctgtctccctttttctccctctgtctctttccctttcttcctctcctgcaaacatgactttcagcaaaggaccaccttactggtcagttcagcatgaggcacttggaagtgtccacagtttcctttatctctctctctctaacacacttttaggaagaacctccctgctgggccagtcagcatgacatcctctacttgtccccgtgggagctccaaaccctccctggggccctgctaataacctggaaaaagctgctgttggcaaaataggggaaggggaaaccgcagaaacacactcacatcatgttacctcaatcagacatgcacttgtatgtggtagttagcataggcaaccacacccaaccagatgtgcacttgggcctctaagtagtaattgctcatgctgcctaagtggtggtcagcatagacagccacacccctgagccctgccagagcacctgaggctcactcaatgcaattccctgatgctaatgcaagagggaggctctctgcagtatcagatgaaacttcaaagagaagtccacaggaatttgtggcaattggttctggaagctggatcaccaattcttggctgtggcctaaaaggagaaagcaggaaaatctgcagaacagatccagccctctgttacctggccaggtacaaatgaatattcataatagccatctcagtcatcaacacagcattgtgatatgttctgtgtcattggtaggcttcagaatggcaccacactgactggaccatttacatctgaagtactcaaaatcttaatggaatttttctttcttttctttttttttttttttttttgagacggagtctcactctgtcactcaggcaggagtgcagcatcatgatcttcactcatgtcaacctctgtctcccagttttaaaatgattgtcctgcgtcagcttcccaagtagctgggcttacaggtgaccatcaccatgcccagctaatttttctatttttagtagagatggttttttaccatattggccaagctggtctcaaacttcttgacctgatgtgatccgcctgcctcagcctctggaattgttatttattaaagttatcagctgggtaaggtggctcatgcctgttatcccagcagtttgggaagctgagtggggagtatggcttgagcccaggagtttgagcccagcctgtgcaacttagtgagaccacatttatacaaaaataaataaataaaaacaagccagggctggtggtggacgcctgtggtctcagttgcttgggaggctgaggagggaggatcacttgagccagggaggtcaagtcttcagtgagctctgaaggtgtcactgcacttcaccctgggtggcagagagagaccctgtctaaacataaagaaataaaattaaaaaaatacctttctttaaagtaactgcaggactttcttcacttcctgcaccatctgaacaagtttctagatcactatgctcctcagtgtcttctttagcaagataggacagatgaggatttcctaaaatcctccaaactctgaattccttgagttcgtagttcataatgttttgcccaggagaccaaatgacttttgacctcaaactagtgctaataacagggaagaggaaaggctcatatttgtagtaactttattttaaaaacaggaacaatgaataatctgatgaaccatttggcatagagatttctatggcatttttgaaaatacatagatattcacatttctcagttgatatgacagttgtagatttagaaagcagtcagaaccaacttcaggagtaatgaaacacatgtaagccacactaattagaggaaagtgttaattatttaagtcagcaggttggaagttattatttgctgcaaaaatacctttttgttggtcatttatgcaaggcagtgcttctaaacagcccatcagtattatcaagaattttgaaaaatatgagcccggcactgtggctcctgcctatcctcccagtactttgggaggctgaggtgtgaggattgcttgagtccaggaattcaagaacaacctgggcaacaaagcaaaaccttatctctgcaaaacattacaaaaattagccaggtgtggtggtgcacacctgtagtcccagctacttgggatgttgaagtgggaggatcagttgggcctggatggcagaggctgcagcaagccaagatcatgccactgcactccagcctgggtagcagagagacactctgtctgaaataaagataaagataaaaatacccaaattgttggccttaggaattctagtctaatgaaggcaaagtacctgtggaaagagacagttttatgaagatattcaccccagtattattatcatagcaaagaatgaaatggaaaagctacaagatcaaaaggagatgaaagttattagaaaccatatgcaataactcaaaagaataataatttacctaagatattcaacagctggaaaaatgcagtgtagacaactatataaatattgggctcagctattcaaaacaatgtttgaatggaagagaaagatgtaagaaagaattatgttaattcccaacatactcattttgctaaggtgagttttgctttaatgtttgacttatgggtgattttttttcattatccaagttttttagtgtcatcaggagttatattactttcctaacatacaaataactgttttatatatgttacttatatatatgtgtgtgtgtatatatatatgtgtgtgtgtatatatatgtgtgtgtgtatatatatgtgtgtgtatatatatgtgagtatatatatatatacacacaaaaatatgctgctacctagattattgccagtagttataagaagggtaggaaaggaacatctcagagcatttttatctaattctgaatgttttaactaatgaaagtatccaacagattacatattgacatttttttcttttggacattttaaaataatcttcagagccaagtactcaagtcaatacttgtacatttctgacagaaatgtttccaagatggctttgctgacataatggttaaagccatattggtttcaagttgcagtcctgtgtgtcatctttgggcaatcctttagtctttaaaaatcatatcttcctgatgacaatcacattttcctcatatttgattgcttccatgacatgaaaaatcaacacggcatctggacttacagctgaatgctttattctttagtgcctgactcagtctgggatttacagaaacgtcaggaagtgatcgtaaatggaatgctgtgatttttacggcctgccgtctcttgtcctgttatgattaaaaatacagattttatacttctggacattcatgtagtagactgagctgatggagaattttaagctatacagaattttactcctaaaattgcccatgctttttcaagtttctcaccaagtggagaatttttcctatgtggcaaaaaaataaaaaaaaaaacaaaaacaaaaacaaaacaaaacaaaaaaatctctgagttaccagtggatatagttttgaagaaaatgacaaaaaatacttgttagttgggtacctggttgaggattaggcatagctaagctaatgcatttacattaattcccaaaccgtaatatcttcattagacgcagggtagaaatgcatttctaaattagcactctgaaattcattcaactggatttattttttcccataatgaagagacacctggatttgtttgtgagacaagatagcctttgatcttttactagtttaaggcctgtttttttgtttgtttattttcccctttggaaatgggaatgtagttgctgttgcatttttatgtatggcatctgaaggtaaggaagcaaaaatgacactaaattgtggaagaaaaaaagaaatcacatgtattttaccagtgcacgaaaagcctcaatgtggtttcatttccttaaactcgtgtgtgtgtgtgtgtgtgtgtagaataacattccctaaaatgaatgttcagggggagggaatcaaaatgaaaatgggtaaaagagccctctgacagagctgaatgctactacatccagaaattcacatgcttgcgaaacaatcacagccttcattgctcagtaaaagctgtttctgtcctgcaggttttcatttgcatgtccgcaattttgcacctgcaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactgggtacgttcttcttcatgttggggtatcactgtcctcttcgcttgtttggttcctcagtataagtgttgcttctaccggcatgtgcaggagcacacatgcatgcacacatatacacatacagacacaagcttacacacacagcaataacaggcagcttctcccccatcatctgtgagaactcaaattttctttattaccaaagtgttttactcctaaaacactttagtgtcaaaccagatttttactagatttctaattgcccattagaaattctagaattcctacttgcaggtgcaggacttacacatatataatggttttgttaacagctgatcacttttgtttttgttcttactgttgttgaagagacacagtctcactctgctgtccaggctggtgtgcagtgatacaacatagcacactacagccttgaactcctaggctcaagccattctcctgcctcagcctcctgagtagcttggattacaggtgactgccatggctggctaatgtttattttttttatttttttgtagagacaagttctcactctgttgtctaggctggagtgcaatggtgcaagcatagctcacggtggcctagaaatcatggatttatttgatcctcacatctcagcatctcaagcagctgggactacagacatgcaccaccatgcccttgcatggatttttgtagagacagggtttcctatgttgcccaagctgttctgaaactcctggtctcaacggatcctccctcctcacccttctgaatagctgggactacaggtgaatgccaccatacccagctaattttaaaatttattttgttagaaacaggattttgctatgtcacctgagctaccacttggggaattgtttagattgcctgaccatatgaatacaaacaattgtcacaatatttatagagaaatataaataaatattcctatatatatttaacatatatagagagaaaagaactattcccatatgtataatatatatattatatatatatttgcatttgtatatatatacacataaataccagtatatttctgtgtatatacatatacaaatagtaatatatatatactatatatgcatatacaatatataatatagaaatacaaacaactacaaatatatacatactatatatacaagtacaaatttatgtacatatacatatatatttgtatttcctttgctgtataaatagatagagagcaaagaaaaatatatgatatttatattatattgttatatgtcatgcatatataaacacatacacacacatatgtcacaggaaagctcatttattgacctaaatatagtagaaaatatacaaaaaacacacatacaacagagactgccaatattctactgagtggattctcttcaaaccatgggagaaaagaaacaaaagcatcctaaataggtccaaatattgtggcatcttttaattttctcctgtctaataatgtaactatggaaatcaatggagtatcattctgttctacctgtgtgtgccaccatcatccaccctgagtttctttaaactgaatagaagagcaacatgtgcatgtcacccagggagggtcaatcttcccatgtggaatgaggctctcagactgcagtggccctgccacgcatgagctgtacacagtaattctgataagatcagaggacacgatttttgtttgtttgtttggttggttggtttttttggcaaacatatagcatgttagcatgtttttgaagtggaaaatgtatcatctggatatcaactttccaaaatcagactgtgtagatttggtctgagaatggctaccaggaggagaacagaggagggaccaacagttgttggagatgctcgtctatcactgaaaggttctttcctgcatgaagaaatgatttaaatcaaattcatattttttttctaagtaaaccttgtttattagttagcttgggctgctgttaccagagtgccaaaatctgtatggctgtgccgggcagagtggcttatgcctgtaaccccagcactttgggaggccaaggccggaggactgcctaaggaggtcaagagtttaagacaaccctgggcaacatagtgagagtctgtctctacaaaacaaatgatgccccacaagccgcaaaaaccagcaagtttttattagggattttcaaaaggggagggagtgtgcaaataggtgtgggtcacagacatcaagtactttacaaggtaatggaatatcacaaggcaaatggaggcagggtgagatcacaggaccacggcagcggggcgaaattaaaattgctaatgaagtttcgagcaccattgtcattgacaacatcttatcaggagacagggttttgagagcaactggtctgaccaaatatttattaggcaggaatttcctcttcctaataagcctgggagcgctatgggagactggggtctatttcacccctacggcctcaaccataagagatgggctcacctaggggggctgtttataggcctatacttccaggcgagtattctctttcccagggatgttccttgctgagaaaaagaattcagcaatatttttcccatttgcttttgaaagaagagaaatatggctctgttccgtctggctcactggcagtcagagtttaaggttatctctcttattccctgaacaattgctgttatcctgttcttttttcaaggtgcccagatttcatattgtttaaacgcacatgttctacaatttgtgcagttaatgcaattattacatggtcttgaggcaacatacatcctcatcagctgacaggattaagaaattaaagtaaagacaacataggaaatcacaagcgtattgattggggaagtgataagtgcccatgaaatctttacaatttatgtttagagattgcagtaaaggcaggcataagaaattataaaaatattaatttggggaacaaataaatgtccatgaaatcttcagaatccatgttcttctgccatggcttcagccagtccctccgtttggtgtccctgacttcccacaacactcagtattagggtgggagtgatccaatgtcccaggtgccatctgttacccctttctttgactaggaaagggaattccctgaccccttgcacttcccaggtgaggcgatgcctcgccctgcttcagctcacacttggtgcgctgcacccactgtcctgtgaccactgtccgacactccccagtgagatgaacccggtacctcagttggaaatgcagaaatcacccgtcttctacatcgctcatgctgggagctgtagactggagctgttcctatgcagccatcttggctccacctaccagtcttcatatattttatagaaccattaaaacaatagtgaaatctaaataatgctgttaaattctcattaactcctcctgactcccaaaggctatgatactgaggctggctatgtcactattaaaaaaaaaaaaaaagaaaaaaaaagatacgaaaagataaaggaagttaaatcattttatgaggtgactattatcatgactggcatcaaatggatgcttttaccaagatatcatgaaagtctgaaagagccgtgagaataccagtgatctctctgttactgagtgctttttaatgccatgaatctatttcttaaagtcacctggtttagagcctgtgatttccaccctgcatttagggagtacattcacattgccatttatggtctgtgttgagggtgcttctagcttttgtgaaggccctgacatcaccggaagagaggaggaaggaaaaaccactagaaccaccagagcagagattctctgatgctactcaaattaaaaacttcagatagagagttcactgaggtaatgagagcctgaatgtcagtctgtctgaagtctctatttttgtttcttccatccataggaaacatccctgaaataacagagtgtattaatgcagtgagttcttttgtttcattagaaatgtattagaatgactcaaatgattcatcaaggaagttactcagaacttacatgtcatgtgaaatgcatgatgtggattcaaatataaatgttttaagtgatcacacttgtttggcagccctataagagaaagaaatgaggaatttcactgttgctagttatttgcttattgtaaactggatggtggcctgatccctccagggcagagaaagattccctggtcgtcaggtgcagagaacaaatgaaactgatacctgtaaggagaaaacatgggatgtatctcatctgctgtcatggtgtgacctggcaagtttaacaccattctacagagcacacactcagacaatgactcacagaaaaggagagggtatttctgcatatcctcactgttcccttccagcactggaggtgacaagaggaaacaagaatagctcccagcgtgtctgtcagtacacagtgctgtggagagaggatcacattgtgccaagacatacttccccactctcagtggtcatcatgtcatgtgttttaaacctgcaggcatagcacagtctcctgatgacaaatgtttgtggagatgaagtggatggtgcctggatgcttctttacagacatctcaaagcagatggttctgattcttactatgagtttaaaagtacatatacctggtatgcatatacctttggaatttggatgatcacagaaaaatgatgttggaatgtgcatgtcaggaaaaattaggaagggaggatgaagggactgaaggaaggagagttgtgatgaaggaaagaagggaaggagggaggaaggagggaggaggggtgggagggaaagaagagagagagaggaagggagggaaagaaggaaggaagaaggaagggagggaatcaagaaaggagtaaaggaagggaggaagtaaggaaagaaagagggaagagggagaagagaaatgaaagatgtaagaagggaaggaaggtgaaaggaaggaagggaggaaggaagggaggaaggaaggaagaaaagaaggaagcaaagaaaagaaagtgagagaaaagaaagagaggaagggaggaggaagaaagaagagaggaaggaaggaaagagagattagggagagaggcaaggataaaaatggatggagacaaaaaagaaggaagggagagaggaaggaaggaagagagggagaaaaaagagggaatggaggaggagaggaagaaaggattgagggaagggagggatgggtaagggaaagaagaaaaacagggaaagggagggtgagagataaaagagggaagggagtaggggaggaaggaaagaaggagggagggagggacaattggatccttgcttacaaatcatgtcacctgtatattttcatgttaatattaggtaagagggccctcccatcttagaaaggcagattcagcaagcacacacagtagaaatgagaagaaagttgctgcagaagctctaaaccatgaaagccttgatcaagacaggatgttgaaatcagtgaatgtcagggcctcaaataatccttgctattttttaattattattttgaatagggaagcaagtgcccaggcctgtgcctgagggggattctcccctgtagcaaggaggtgtttcaatgttagtccaggtcacgggactaaaatcatgcttgaagagaactgagtaagcccaaacatgcaaagccattgtagaaataaggtagattaaaaccatttttgtaaatgagaagcaccatcaagcaaaagtgaaaactaactctgaggtttgaaaggggctctagagaattaaacttattttcctctaaaattatttgggaaataggagaaaaggggtttgtctaagctgatcaataaaatgcaggtgcccattgatccaggattctctcattttgagctctatgtggaaagagatcggcaaaaaggagtgggggaaccttggtcttttttttttttttcttccgagacagagtctttctgtgtcacacaggctggagtgtggtggtgcgatctcatgtgatatcagctcactgcaacctccgcctctgggttcaagcaattatcctgtctcagcatcccaagtagctgggattacaagctcccatcagtgtacccagctaattttatttttagtagaaacagggtttcaccatgttgtcctggtctcaaacttctgacctcatgatctgtgcaccccagcctctctaagtgctgggattataggcttgagccactgcgcccagccaaatcttggtctttttataagatatgacaaagagcagtgctttaaagtaatcaaacaatacattataatatgtaatagaagaagttgtgtgctattggaagtcagaaatgggaaaagagttttgtaatggaaaatcagatcaacatgtattttcattttttatgttgttgcactgagtctgaggcttgtacatcagattgatttctatcttttttgcatcagacaccatcactgctgttgaatgttctctattctatcgataatttatattcaaccattgctaaatctgttgaggaaaaaagaagtcccaatgaagtgtttagcagggattggttacagagagttgcagcataattctagttgtaaaggtgacctttagtaccaaaaagggattttaagctgaatgaatgaacatcctcccctggtgtggtggaggagtcactgaatgtataataaactagtttgctaacaatgttttggatataaggaaaacctgtactacttaaaggaacagctgagagtgttcatggatatttttagagagatcatagtactatatccatctctagctaaagaaatgaacaagaccttagaaatgcacttgagtctctcctgccaagattacatctcaaatagaacaggtggaaatggctgtgttaggtgctaggggataaggaggaagacaggcattgagtcttttactagagacaccaactagtgtttctatcctcagtcattacaatctttaattttactcacaggaatttaaacatttcttatgctgaataaaaactaaaaaaataaaacactgatatcacacatctagacctcactgtctgcagggtttggtaagggagaatgacgtgggctgtcataatctccacaagcttatcagtgcttaagaattctggctatgcatccctgagatctttaatagacagattacatcgggcagcagctcacttatctggatttcccaaatcctctcctttattcttcaagaatacatgttttttatttattttttaaagaacagaataaatgttttttctttacctttcgaatataccctgaatccttcaaaaattgcctaatagtcaacatgaacagaatactccttttcctagattctcactgcttagtagatgagatagccacacatctaatagacccaatttagaaaaattggatccatgaaaaaaacgaggaatcttcacttccatttgtttctttagaacactaaaaattaataacaaatattagtacgaagtttttcctaaaatatttattcatttatttttctttcaacacacattaagtaaaaattttataattatttcagaaggcttaaagaagcaaaagaaacatgagatgataaaatgaatccagtgttttttcaaagccgtatcaaaatgtatgcataacaaataaaaagcagtagacttttcaaatatattttttatgaataaatatgagatctcatggtattcaaacttatgtgattttatatatatatttgttttcaccctcttagtaacgtgaaagcacggcagttagtgtgcattcaagtaaaaggtagaggtcaacattctttttcttctctattacattatacatcttatatctgtatctatagatagatatacatgtacacatatgtacatatgttatacatacatatatatactgcatatagtatatggttagtatacagtataaactctggtacacagtatacttatatatagtatgtaatatacagtataccattatatactctataatgtacataatatagaattatagtatgtactatgatacacagtatatcactccatcactccctagttccccctcccttgcaatattgtaggtgttctaatttttatattggaagagaagggataatatttcctgaattcttaccatatgtcagacattttgtcattatctttcaaccttcatcacgtgtctccaagcctgatattcttattctctatgtagatgggtaagttaaggccaacagtggctggaaaatttgctcaatatttcacagctgttaatgagccagagcttcagaaatttgaatacagggacattatttcctttacgaccaccacagactcagattgaggggagaaaatcttcctttatcacatgtggcatctctgagtcaagtatattgttcaaatcctgcacaatatctgacaatgactagacatatgctcttccttggtcctgtagccttctgccatacaggtcaatatgcaatggttggaggcaacttcacaaaagtccccctaaggaggagttacctggaggatggactttagattacacctggaaccattgatcaggatgttgcaactccctgcctgcctgggtctgcacattacatctcaatgctgagtactaaccattagatgacattttaccatgcacaatctcaattttttgtaacaattaaaccttaagatgtaattggttttatagcttactttatcaaccataaggaaaggtagaaatgagaatttggtatatttgttttttgaaggggaagtgttatcttaaaagggttagttgcaaagatgtttaaaggctctatgctttatgaattatctccaaatttttatgattctccttctacctctgcccacttgtgcaaataataataagataattcttcagtgtatagcttccaagcacaatttagcatctgcagcagccctcagcttgtttctgggtgtcttatttatactaaatatgttaaccttggcgtaaatatatgtaccattttaacaaacttcttacagctgctgtaatgtgctttcatcttttctggactctgtcttcaaaaattgtccacgtgtgtatgtatttcactttcaaatagagagcaaacaaatgatgcatgtgttgacttgcagcttttaattataaatcctattttattttgagtgttaatatcaattttcattgctgtaactgcaatatctgttcatttacttcaaatgcaattattgagtaagaaagagaatgcccacttgttgaaaaattcttaatcagaatttctcagcctgagtactgttaacatttgggtccagataacttctttgctgtgggggtctctccagtgcaccagagggtgtttagtagcatccctaacctccacccttcataggaactgccctctgtctacaaaaaccaaaaatgtctccagaccttcccaaatacccctctggggcaaatcactcctggatgagttttgcagttcagaaacagtgaaacttgaaatactgaaatttttcccagagacacttagttttcctttatttttgaagatcatttgatgcattaaaaaatagtaaacatgttataaaaattgaataatgatgctgtcaggatttatatttaaaagaaaaataagagcaatttttaaaggaaaagacaacatgatagacatgcctaggatgaaagcagaatgtacctttgctgcttgggtattttgtgctcattgataaatatatatgaagagcagattgtaacttcctgatttattggtttaagataatttcatatcacatgtggaagaatatgacctttctttttttcttccttctatccccagtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttatagaaaacgagaaaaaagaaaaaaatgagaaacaagtaagaaaaaatcctttcctaggcttttccttgatcttcagaggcacacagggtttaatggttccttaggttattattttgaggttttgttctttcttttgccttaagtaatgacagaagatatatatggccagacacatatgtataaacttttcagcagcattttaataataaaatatcacactattttctaatgctttgtacaaacaattatgcatctgttctttcttggtaggtggaatattttatttacttttgccattctttgaatgcctttttctttgtaaatgctacatggtagctctcacataggctacaaatggataaatacatttggtaatgggatggtttctttagctttggccagctgcacagttgaggaggctctgctggcctgattttggaaaaccaagccctgtttggtgaagctcctgagatgacactgcctgaaaatgagtatttggttgtgttatttctaccactgttcattcttgtgtctctgtgttttgatttgtgttcaacaaactgatgccttaatggtttcaaatagaaagccttaggtgagtaaaccttctagtgacagtaagaaattctactgaatgaaactccagaggcagaaaatcattgtcattccaatgggagctcaattgtcaattccttcctgtgcattcagccatcacgaacttatttcacattcacagtagctctaaggggcaggcacctgcattactcccctttcataatggaagatgttctgactttgaaacatgcccccttggacaggaaaatttgatggataacaggatagcatatcctcatatcccaatctttcaccaagaagttatacagcaaacacttgtaagtcaaggtcttgcatgataatctttgctaagtagcaagtaaagaaatatagcaaggacccagactctttggaatatgtgaactaaatccttcagatgttgttggcctcaatcatgttgtgaaggcacacaggagaatacatacacacacatatgcatatatgtatatatgtacatgtatgtgtacattatatatgagtatacatgtacctatcctatatatgtatgtatgtatagagtcacagactgcataatgttttggacaaatatagatcacatatatgatgatagtgtcttgagattaaaataccatgtttttattgtaccttttcagtgttcagatatgtttagacaaacaaatgcttatcattgtgttacagttgcctaaggtcttctctccagtcacatgctgtacaggtttgtagactggaagaactaggctataccatagagcctaggtgtgctataggctacacatcggttttgtgtaagtatactacatgatgtttgcacaatgatgaaattgcctaacgaaacttttctcagaaacctattgatacatgactgtgtatgtttacattatatatactgtatatgcacacatgcatatatgcatatatatgttatacatttacatatgtacatggatatcacatactttaaattcctgaagatgtcattttcattaaatacatatgcacacacactcataaacacacacagactcatatatacacacaaatctataacacatttgtgctcacatatacattcctctgtgtgtgtgtgtgtattacattactgctttttatctgtgaaatcacattctgcagtttcatttactgtgatcaactatgatctaaaaatatatgagtacttcaataagatattttgaaagaaaccacattcacataacatttatgacattataattgttctattttattagctattgttcatctcttactccatctactttataaattaagcttcataataagtgtgtatatttaataaaatatatagtatataaagggtttggtactatctgtggtttcaggtatccactgggagtcttggaatgcattctttttggaaaaggagcgttacactatatacttacatatagacacagatgcatatatacacatacataatttacatatatagacatattcgcagatatgaatgtacttaaatctctaagaatggcacttttattaaatgtacacaaataaacatgtatacacatacatatatatatatatatatatacacacacacacacatttaactgaatgtcatcttcaggcattcaaagcctaatttttagcaaatttcagctggagggagaatcactcttgttttgactattttatgcattcttgttcattttgaataactcaaggaatgctaaaaattatatgcatccattcagtgaaactttactgaatatcttcactgcctcaggccctgtgctgggctggtgttaaaattgaagaacaaacttctcacaccacaaaacttgaggggaaggcagagaaacacagaagcaaggagaggcaaggggtgctggagatggcacccatgttaataaggggtgctaataaatgtctggacactgcccttaacctagtctgggaagatcaggaatacattctgtctgaagaaacccctaagccaggtctttccaactctgtagaaaaaatactagtgggtggtgtgttgtggggaggatagaattacacatctttgaagtaagaagacagacgaagacataggaagacatggctcctgcatcatgggtgaaaaatataaggtgttttttagaaaggtgtgaaaaatgagacagaaagaaattggctgataaaaaacctccaacaaatgagacagaaaggaactggctgataaaaaaacctccaactgcaagacagggagtttgggctttgtcctgaagtcaattgagagacaccaaatgattgcaccaaagtggattatgagtgtatttagttgagacatttagcagtaattctcaaaagttcacatgcttaggaatacacgggatgtcaacttaaagtacagatccttactgaattgtggtttggtgaacctgtgtctgaatttccaagacgatctctaagtgatgcacttgttgctcattctcaattaaccccaacttatttaggttgcaaaggatggagaactgttcactttagaagtaaccatgaggataatctgcattggaatgagagggttctggatgcaaggacaacattaaagagccagagcaatcagaaattaattactgtcctctttttaagggtgatggagaccgtaataagacaagaagtaaaaaagaaaaaaaaaacgataagaaatgcatcttatagctgcatgtaccagaactgataaagcgtagtcatcaaaaaccacctggaaccacatttgtccttaagcttttgtttaggaacttgtttcaacagagagaggagaatgatgagataccttggagagagtttcagacaggctggtcaagggtttgggcttagactgggttgttttataagtgctaagagggccaaaaacttgttcctgcattggttactgtcatgataatggggatgtcaatatcctttagcaagaaagtgacaggaccagagaatgactagcattgtcttcagtaaaaataagcagtggaagagaaggggatttggggtcattttcagtgtttccagactgttcatgtttctggcttgtcccatgctggccgtgggctgccttcatctaatgaggaagttcgttcaattatttttatgtgcagccagatgcaccttgacttagcaattaattatcaggctaattctagcagccagatataagggctgttttttgttgtttctcagaacttccaggaaatatatgcatatgtcacatctcctaggccacctggttcaaaaaaaaaaaaagttatgctaaggaagtaaaagtgatactttctctgcaaaatcttattaatatattgaaagaaattgagatataaaaaaggtccactgtacctctacctttctctaaaatgatcatacatgtaaattcttagaacacccacaaataatctggtttcctctactggcaaaagaattagaaaaaaaaaaatgagaaaaattagccaggagaaaaccctgcctgaaattaacaggtgacattcattaaagtggaatgttccaactagttctcaaagtcactgattcctaaaagggccggagagggagtccttggagactaagacaaattgccaacagccatagctggaaggttacaaaaaagaaaaatctttctcacccccgggccctaaacacaagaacttggactcagcagaaaggaagtgggaagatgcatttctggcacaccaaaatataaacctaacaactcctgtaaaaactgagaaatcagatggtgcccaatttataatattagagccactattacgcttcagtggtacaattggtcaaactggtttcttgtgggctcagatgttagcttcatttttatgcaacacctgtttctacaagtatatacgttatgatcacagctttcaaactaacatgcttggcctgcctgggttattggatgttatttctagtatttaaagagcaattacagtttttagattataataatagaaaagcacataacaatttataagtatatgcattacctacagacaaacttttcaaataaatgtttaagagattttgtaaaagcattgattcaaccatttacagagcaatcacttgtttcaagttttaaaactttcagataatcatcaaaatgtattgttctgcgtaagttatatgcattaagtcatttaatccttttactagttccagggtgcagactctcattttacagatgaggaaactggggtacagaaaattaaataaattgctcaaggttgcagacttagaacataaaatttatagcgttcacaatcatattgttttgtttttaagagcatgtgcttgtcaactattctctaaaaaacctggttattgcagaaatatatgcctccctgtagacattttggggaagaaaaaaatcactataatctgtttgtagagaacattgatagctttatatcttaaaaacttgtcatgtacacacacacaaac

SEQ ID NO: 5 - DNA, 5338 bp, homo sapiens
  exon (1)..(153)
  exon (154)..(724)
  exon (725)..(784)
  exon (785)..(937)
  exon (938)..(1048)
  exon (1049)..(1234)
  exon (1235)..(2024)
  exon (2025)..(5338)
tttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagcacaaaacaccctggctcatggaaactgcaagcatcgttgtcagctgcacctgcaggcaccacgggattgcaagtcagcataccctttcagaaatgaggatgaaattagagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttat

SEQ ID NO: 6 - protein, 873 aa, Homo sapiens
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILAQNTLAHGNCKHRCQLHLQAPRDCKSAYPFRNEDEIRGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 7 - DNA, 5460 bp, Homo sapiens
  exon (1)..(153)
  exon (154)..(724)
  misc_feature (253)..(1074): open reading frame
  exon (725)..(784)
  exon (785)..(937)
  exon (938)..(1048)
  exon (1049)..(1170)
  exon (1171)..(1356)
  exon (1357)..(2146)
  exon (2147)..(5460)
tttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagcacaaaacaccctggctcatggaaactgcaagcatcgttgtcagctgcacctgcaggcaccacgggattgcaagtcagcataccctttcagaaatgaggatgaaattagagatggagtgttgctctgtcacccaggctgaagtgcagtggcatgatcttggctcactgcaacctctgcttcccaggttcaagcaattcttctgcctcagcatcctgagtagctgaaattacagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttat

SEQ ID NO: 8 - protein, 274 aa, Homo sapiens
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILAQNTLAHGNCKHRCQLHLQAPRDCKSAYPFRNEDEIRDGVLLCHPG

SEQ ID NO: 9 - protein, 394 aa, Homo sapiens
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPND

SEQ ID NO: 10 - protein, 43 aa, Homo sapiens
PEGKDTLRETIKFMYTDWADRDNPETRCKTLVALFTDHQWVEP

SEQ ID NO: 11 - protein, 39 aa, Homo sapiens
PDDIPLMTPNTITMIPSSLVGLQTLHPYNTFAAGFNSTG

SEQ ID NO: 12 - DNA, 3813 bp, Homo sapiens
ctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatccccgccagttatggcaatgtcatagtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacgaaaaaaaaaa

SEQ ID NO: 13 - DNA, 3813 bp, Homo sapiens
ctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatccccgccagttatggcaatgtcatagtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgctgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacgaaaaaaaaaa

SEQ ID NO: 14 - protein, 828 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDGSGAKKQGEDLADNDGDEDEDIRDSGAKPVMVYIHGGSYMEGTGNMIDGSIPASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 15 - protein, 828 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDGSGAKKQGEDLADNDGDEDEDIRDSGAKPVMVYIHGGSYMEGTGNMIDGSIPASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRCKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 16 - DNA, 7000 bp, Homo sapiens
gcaaaccacttaacaatgacccaccacaaccctgctatttctgaatttaccttatctttttttttcctttcacaggcagactataattatgatttcaacttcctcatcggatccccagtcatgaatctatctaacatattcagctgaaggctgtcaaggatctactgattccacaatgcagtggtactctcccatcgcccttcactcctaaaatctctgaagaccatgacacagttgactcctgcctactccttgtggaggttaaagtccttccttgaattccataccacactttctcttaccaaagatcttctgcagatgggagaatgaccctattttaggttgttatcaagaccctacccagtgtcactttctccaaagatttgccttttctcttaagggaacactttctctattttacaccaaaatgttaagtatcatatccatagggtttgtgcttggatccgtagatcctaccttaagatccctattcaggtcaaatctcctgtcccaaagatctcaggtctgtgggtcattggtatttctatgatccaccagcacctcatttttctttccacacaagtgactctggctgagtgcactctcattcatcttagccttcccatctcaccacatgaaggctatctctagtatcttctcattttagggctccatcccatttttgctcaacttctgcaactatgcatatagtcaaatgccactcatagtgaaataaattcatcataactgtgttattttcactaatactgccctaatttatgaatgcagcagcctcgctgtactcttttgttctagaatgtcccagcccttaaatcccctcagagtaagctctctgaaaggtaatctctgctaccatccccgactaacacccataaggattccagccaatgaatattcatcaacctctgtagtccagcctgaccaatttcttcttattctcctctatgaatcataagaacctatcatcagctcaccaccactcctgttttcagggtttaatttgaggattatctaaaaaagcaacctcatgtagcagggtggccccccaaatgcaggttccaagaactcactcaagacctgctaggtttgaatcctggtgtttagctctagaggcatggattttgtaaccatcttcctgggtcatccttgtgcaccttgaacttccaaagcctttgctcacactatatctgtttctcgtctccagatattgttaacttggaataatgtcccacccctgctctccaattccccagggaaaccttgttcatctgtgaaccattttctcagcatcccaataggaagcctgttacgccttctgtatgctttggagatggcatatgtcacacattgagttgcattttaataattaaagagcttaatttatcctcttattagattttaagcaccttctatactatacatatttctctctctaataatgattagtaattaataacatagtatatattactattgcacgaacaattattatcctactgaaaatatttctgtttcacttggaccattgtattaggagagtcagtatgaatcagtagtgccccactggcttcaccagtattgcattcagagttctacgtattgatctcacaggagcttgaacataataccagaatgtggttgatggagacactgagatggaaaatcagagagaacaagtagtgtggtatagattatttctcatgttccctccagttcttgtaccaaactcagcttatatatctttcttggaaccctacagttttatttcattttatgactcccccagctcccacatttcaccatactccacaattagatttaaaatggaagcatgaagaatgatactcttatctcttccaggaattgtggatctaaacctctgtagctcctctgtctgtgttgcaatctggtggcccagttgttaaaaattggtgttttgggtcctatcctggtctcctgtaagggattttggattagggaaaatgataatttcataacatcttatattcactttttcttacaatcatgattccacctgtctaagatgctttctgacttttttctttttttgagggagggtctcattctgcaacccaggctggagtacagtggcacgatcatggctcactgcagcctcgacctctctggctcaagtgaccttcccccttcagcctcctgcactaccactcccagctagtttttaatttttttatagaaacagggtctcactatgttgccctatttttcaaattattttaaaaaactctcaatggagtcattcagatagaagtgaaaatgtgcttgcctgctctcttccaggtcacatatctcagggaagagatctggtacccaaccaatccacccacaagctaagccaagcattcagattttgcccaaactctccttcccaatcttactttatcatgctgccttatttagaagtgatgtctccccacatcaacttctcttcccttcactacccttcccttcctttttcctcccttccctttctccttttctctttctctctctgtgtctctcattcaggacttcatttgttgcatccattcttgcaacaatcttacaaatattttcttttctttccacgttggccctcttcaacttgttctccatattgccatcacagtgattgtcctaaaatataaatctgatcatttcttcccctctccctgcagaaaatatgttactggctttcccactgcctactggataaattccaccttttcagtatggcactcaaaattcttcacaattaggtctttaatcctttccttaccaccttcttttcatactcaatgtcatggcattccaaaccctccctatttctagatctccacacatacagtattgctatgatgtctttatccatggcttctttctcaacttcttgacccaatcagtgtctgtgtaccatttcttccctactcagaaagttcttcctttgcaaacccttctttaatcattttcacctccatgggtccctatgaattcatatgtattccttgtgcacaccttcttgtaatcatattttttctcatgcttttggctatcttgtccactagactgtatgctttctcaaaaataaatggatgagtttcactcacagatgcatgtcagtgcttaggactgcaccagtgctaaaaaaaaaacaaccctgaatttatgaataagtcaatgaattaatacattcttggcaaaacccatgactttctggcctactataaattactgtgttcaaggtgagattctgctttagtttaggatatagatatctatatatatgtccatatatctgcagctatatatccatatccatgtatatcactgatttggggaataagctatacttattaacaatattactatgttaatgggtcttcaatatctatacaataacggaaaaagtacatgcatatttctaaatatctatccaataattggaacacacacgtatgtatggatggatatatttttttttattattgggtatagatatctattaatagataagtgtatatttatgtacctatcttgttggtaaaaggtgcttttatacatattatttcatttagtctccacaagaaatccacaggaaaggtaattttaatctcagtttaacagattcacagaacataactgactttacaacaaggcaaagtttgtgaggatagagtcttaacatgaaaccaggtccccaaattggtgtctatcaccttccccattattggtcaggctgcccaaatatccttcacatcaccatggcaggcttcatgctttggtttactgcctaaagccgaagcaattaggaggatatcctatgtgttgcggacactatctttttccttccataaatgaattaatgggccatgaaataattttaagaaaagctaacttttctggccaagcagaagaataaaagtaatcaccatgtaatattgttgtgaagactacctggccccacacattaactcagctaatcattacagtattacacggtgattatctgttccattttacagatacagaaatggaggcaaacgattaaaatacacacctaaggtcacatgcatcttgaacccaagcaatctcattttaaaatccgtgttcattgtcacaacactctattatgccctctgatctttgcattgccaatttaaatccaactttctccaactcaactttaagtacaggggtcatacccccgtcctcgccccccgcaacttgaaactccctgggaaagataacctcctggaccctggaaatgaagaggcgtatttaaaaacaaatgcctcatcctgggcacaattccaacattttatcaaaatcatgaaagtataagaatagaagtaaacaaaaagctttcatcgatcccctctcaaccataccctgagcataaaacaggtcctgtactttacagaactgtattccaaattttgctgctcttaaaaattttttttatatcattgcttcccaaatgaattacaataacgcagacatagagactgctggagatcgtgaccttaaacagttaaagatgtttgcatatactgcagcatgtttggtgtggagggtatctagagagtcctaaaaaagcaaagaggaagaaggtttgctgtacgcgtctggtgcggtggcaccgtttgccatgcccacctgctctatctcccgagtacccgggatctctccgttacagctggtttgcattgggattagcagctctttgcatgaggttgtagctgtggatgtggtttctgtagtgatggggccgactccggagatctattggctgctggctttgtaaatttcattcagtttggtccaatggcagagggagagccccggagacagcaggacctctctcctcaatctctctttttcttgcagaaccgtctctctcccttctctgtctcttagcacagagctcttattcagccactagcttggcccttcctgcttcaattgtaatgcttgttctgcccgtccacagactattggcggcagaaacaacgaatttcctccaaactaggcggtgttggtggctcttgcattcctctggatgaggaaatctagttggggggttccagaaggggaaggctcctgggctttcaatacatcctcctgaatcatacctcgtttcgggttccctagaaaaatctggacgtgtaaaaagaactcttaacggccgatgcagctcttccaaagctaaggtaggtgcagttttaagacctgtctctgggacattattctcattttaaaaagccgtttaaacattttgacttgcagcaaaggatggaaagcctcactgcagatacttgagcttcacttcatctgatctttattttttccttttatgattattaatattatttttggaaaatttggacaggactttctcccatctgtctcgctgcatttcttaggtgtgggtgggagtgtagaccttcatacggtttttacatgcaacctctccacagaaatatttggttttattttcacttaaagagaaaaatccagaccaccgttgtttggaagcgttttgctgcaatcagctatttgaacggctctggggccgtgtgtgatgtgtttacaaagtagcgctgccttccacacaaataaacagaagactgtggcggggagaggaggaaaaaaatatatatgtatctgcagtacagggagaagaaggagagaagcggccagggctggagatggtgaaggcaggaagacttctgcaaactgtgaggcatgggaggcttttcttttctttttctctccccccccaccccccccccttattctttaagaaaactgtcagctaccaccgcctggggtgcttttttgaggggttgggggggtgctgttaaccagaaagaaaaagggaaaaccggcttggttggggtcgcatttaagcgattttttttccctccttcatctccgggcctcggataagatgacggcttgggtgatgcacgaaataacgcacgtgattgattagacctggcttggcttggctagggaacgatccaggcgcgctggagaccccgcgtgaagatgaaatgacggtagctccgggctgcttctgtaaaccggggagcgggctccatgcacccctttcccgtgtgtgtgggtttcgaggcgggtgggaagggtgaggcaagccgcagaaggagggtagagctggtggttttgcttctttcggagcctttgagtgtagtctgaacctttgaggggggcgcgggggggcttgcagctgccgccctgggaaccatctctgaactgcccgcttttccgaaggagcggaaaagttggaagctgcgaggacagactaccggagccctggtctgggtctcgggggatctggagccctagtcggtgcccactgagaacaccccttctcggagcgagggtgtcggggggagtgttaagcctgcggggcgcacggtccgccagtccccgaggtggggacgggggaggaggctgaggagtcggttccaataggcgcaccacctctacagccctggaaaacgcaaccgccaccccctcttcccttccatcccatcccaagcctctctgctgtcccgggccgatttcatctcgtctcttcccccgcctccccgcttccccgcctcccaattcccgcgcggctcggctcagccccttcccactccagtgggcagaactgatggagaagatccgccaagcgcgcagccggcggcggaggagacagtgcggggtgggcgaggggcttcgagaccacgcagagagagagtgaacttcagtcctgacccctccccaaggccgcggctggggcgcccacagcccgcgctggcacccgcgtggcctgacctgcggaagcgcgagcggggatgaggtagggagagggaggtaggtgccgctcggctgcagatgatgcgtgggtggggggcttgctgtgggaggagaggcccaggtcccggcctgc

SEQ ID NO: 17 - DNA, 7327 bp, Homo sapiens
aaaaaaaaaaaaaaaaagatccaccacaagcctgctatttctgaatttaccttatctttttttttctttcacattaagactataattatgatttcaacttcctcatctgattcccagtcatgaatctatctaacatattcagctgaaggctgtcaatgttgtactgattccaaaatgcaatgatactctcccattttccttcactcctaaaatctctgaagactgtgacacaattgactcctgcctactccttgagaaggttacaatccttccttgaattccatgccatgttttctcttgccagagatctttgcagatgggacaatgaccctatttcaggttgctatcaagaccctacccagtgtcacttcctccaaagatttgcctttccttttaagtgaacgctttctctattttacaccaaaatgttaagtatcatatccacagggtttgtgctcagatctacagatcctactttaagatccctattcagatcaaatctcctctcccaaagatctcaggtctgtgggtcattggtatttctatgatccacaagcatctcatttttctttccatacaagtgactttgggtgaatgcactatcactcatcatatccttcccatagcaccacatcaaagctatctttagtcttttctcattttagggctccatcccgtttttactcaacttttgcaactatgcatatagtcaaatgccatccatagtgaaaaaaatttactactactctgaaatttccctattactgggtattttcactactaatatcctaatttatgaatgctgcagtatcactgtcctcttttgttctagaatgtcccggatcttaaattccctcagagtaaattctctgaaaggtaatctctgccaccatcccccactaacaccaataaggattccagtcaatgaatattcataatcctctgtagtccagccttcttattctcctctttgaatcacaagaacctacaagtagctcaccaccattcctgttctcagagtttaacttgagtattatctaataaaacaacctcatgtagcagggtggccccacatattcaggttcccagaactcactcgagacctgtgaagtttgaatcctggtgtttagctctagaggcatggattttgtaaccatcttcctgggtcatccttgttgaccttgaagttccaaagcctctgctcactccatatctatttctcttctctagatattattaacttggaataatttcccatatctactctccaattccccagaaaaaacttgttctgtgaacctttttctcatcatcccaataggatgcttgttatgccttctgtatgctttggagatggcatatatcacacattgagttgcattttaataattgaagagtttaatttattcccttattagattttaagcatcttttatgctatacatatttatctttccaataatgattaataacatagtatatattattattgcactaacaattatcctactgaaaatatttgtttcaatttgaccattgtattaggagagtcaataggaatcagtagtgccctatagtgtatctggcttcaccagtattgtatttcgagttccacatattgatcccataggagcattaacataatagtatgtatgaatgtatgtatgttcataatagtatgaacataacagtatgtagaatgtagttgatgaagacactgagatggaaaatcagagagaacaagtaatgtggtatagattatgtctcatgtttcatccagttctttgtaccaaacccagcttatatatccttctaggaaccctactgttttatttcattttatgaatcctcctagctcccacatctcaccatactccacaattagatttcaagtggaaacatgaagaatgatatccttatctcttccaggaattcagaatttaaacctccgaagctcttctgtctgtatcgtaatcctgtggctcagttgttaagaactggtgttttaggttctatcctggtcacttatgagggattttggattagggaaaattataaactcataatatcttatattcactttttcttataagcatgattccatttgtctaagatgctttcttaattttttttttttttgagggagggtttcattctgcaacacaggctggggtacagtggcatgatcatggctcactgcagcctcaacctctctggctcaagtggcccaaccttcagcctcttgaatagctggtaccacaagcatgcactaccactcttattttaattttttggtagaaacaggatctcactacattgcccagggtgatatcgaactcctgggctctagtgttccccctgcctcagcctcccaaagtgcagagattccaggcatgatccactgctcctggccttttttttttttttaagaaattaattaattaattttaaaaagtcttagtgaagtaattcagacagaagtgacttgtctgctctctcccaggtcacatgtctcagggaagagatctgctacccaaccaatgcacccacaaactaagccaagcattcagattttgcccaaaatctccctcccaatctcactttatcatgctgccttaaagtatttagagttgatgtctccccacagcaatctccactcccttcccttcccctctcccctcccctcatctcccctgccctccactcccctccacttcttttctgtcccttctttttctccttttctctttctctctctgtctctctcattcaggacttgatttgtcacagccattcttgcaacaaccttacaaacattttctttgctttccacattggccctcttcaactagttctccatgttgccatcacagtgattgtcctaaaacataaatctgattatttcttcttccctcactgcagaaaatgtgttattggctttcccactgcctactggataaattccaccttttcagcatgacatttaaaactcttcacaattaggtctctaatcctttcctcactaccttcttttcaaattcaatgtcctgccatgccaaaccctccctatttctagatctccacacatacagtattgctgcgatgtctttagccatggcttctttttcaacttcttcaaccaatcagtgtcgatgtaccattccttccctactctgaatgttcttcctttgcaaacccttggttaattattttaacctctatgggtccctattaatttatatgtattccttgtacacaccttcctgtaatcacatttttttctcatgcttttcattatcttgtctactataatgtatgctttctcaaaaataaatggataagtctcactcacagttacatgtctgtgcttaggactgtgtcagtgctaaaaaaaaaaaaacctgaacttatgaataagtcaatgaattaatacattcttggcaaagtccatgactttgtggcctattataaattagtgtgttcaagttgaggttctggtttagtttaggacatagatatctatatatagtccatatatctacatatatatgtctacatccatgtatatcactgatttgggggataagctgtatttataaacaatactatcatgttaatgggtcttcaatatctacacaataatggaaaaaagtatatgtatatttctaaatatctaatgggaacacacacacatatatgtatgtatgtatatacatttttctattattggctatagatatcttttaatagataagtgtatatctatgtaccaatcttgttggcaaaggatgctttcatgcatattatctcatttagtccccacaaggaaaagcaacccacaggaaaggtaataataatgtcagctcaacagagtcacagaacataactgactttatgacaaggcaaaatttgtgaggatagagtcttaacatgaaaccaggtccccagattcatgtccatcatcttccccattattgctcatgttgtccaaaatccttcgcatcatcatggaaggcttcatgcttaggtttacttcctaaagcagaagcaattaggagaatgtcctatgtgttgtggacattatcttttttccttccataaatgaattaatgggcaatgaaataattttaagaaaagctaacttttatagccaggtagaataaaagtaatcaccatgaaatattgtgaagataagcaggccccacacactagctcagctaatcaatatgacaatattacatggagattatctgttccattttacagatgcagaaatggaggcgaatattaaaattcattcctaaggtcacatgcaacttaaacccaagcaatctcattttagaatctgtgttcattgccacaacattctatgatgtactctgatctttgcattgccaatttaaatccaactttcttgaagccaactttaaatactgggaactttaagcattgtcaatttcaagccaactttctccaacccaattttaaatacaggggtcacaccctcctcctcgccccctgcaacttgaaactccctgggaaagataacctcctggacctgggaaatgaggagtatttagaaacaactgcctcttggtaagcacacctcctatattttatccaaatcatgaaattataacaatagaagtaaacaaaaagccttcattcatcctctttcaaccataacctcggcataaaaagctcctgtactttacagagctgtattccaattttcgctgctcttaaaattttttttaatatcattgcttcccaattgactcacaataacgcagacatagggactgctggagactgtgaccttaaacagttaaagatgtctgcatatacgacatcatgtttggtgtggagagtacctagagattcctaaaaaagcaaagaggaagaaggtttgctgtgcgcatctgggtaccctgctctatctccagggttcccaggatctctctgttacagctggtttgcactgggattagttgctctttgcatgaggttgtagctgtggacgtgggttttgtagcgattgggacgactctggagatctattggctgctgggtttgtaaatttcattcattttggtccaatggcagaaggagagcgccggaagcagaaggacctctctcccctagctctctttttcttgcagagacatctttctcccatctctgtctgttagtacagagctcttattcagccactagctcggcctttcctgcttcaattgtaatgcttgttctgcccggggacacactattgacagcagaaacaatgaatttcctccaaacccggcaatgttggtggctcttgcattcctctggatgagcgaatctagttggggggttcccgaaggggaaggcgcctgggctttcaatacatcctcctgaatcatactgcgtttcaggttccttagaaaaatttggatgtgtaaaaagaactcttaacggcgatgcaggtcttccacagctaaggtaggtgcagttttaagacgtgtctttcgcatattattatccttattttaaaaagccgtttaaacaatttgacttgcagtggctctccagcaaaggagggaaagcctcactggcgatatttgagcttcatttcatctaatatttatttattttttccttttattattattattattggacaatttgggctggactctctcccatctgtctcgctccatttctttggtgtggatgggaatgtggacatcgatgtatggcttttacatgcaatctctccacaggaacatttggttttattttcacttaaaaataaaaatgcagaccaccaatgttgtttggaagcattttgctgcaatcagctgtttgaacagctctggggccatgtgcggtgtgtttaaaaagtagcgctgccttccatacaaattaaaggaagactgtggcggggaaaggaggggaaaaatatatatatatatacacacagacatatatatgcgtatgtgtgagtttgtgagtgtacacatacacacacacatatatatatgtacacacacacacatacatgcagtacaggggaaaaggagggaaaaggccagggctggagatggcgaaagcaggaggacttctgcaaactgtgagcatggaaggcttttcttctcttttctccccactccaaagccctcgtcttctttaagaaaaccaccactgcctggggtgcttcttttgggaggctggggttgggggttggtgccattaaccagagagaaaaggggaaataaagcttggttggggttgcattatgagatttttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactgtagctccgtgctgctcctccaaactcgggagcggtatccatgcacccctttcccgtgtgtgtgggttacgacgtgggtgggagtggtgaggcaagccgcaaaagtggggtagagctggtggttttgcttcttcggaagcctttgagtgtggcctggaccttagatgggggtgcagggcggtttgccgctgccaccctcggcaccatctctgaactgcccgcttttccggaggagcggaaaagttggaagccgaaaagacaggcgcccggagccctggtctaggtatcaggtgatccggagccctagtcggtgcccactaagaacaccccttctcccatcgggggttcggaggagtgttaagcctgcgggtctgccagtccctaaggtagggatgggggaggggtctgaggaatccgttccaataggcacaccatccccacagccctagaaaaggcaaccaccacccgctccttcctcccgcaccatcccatctcaaggctctctgctgacccgggccgatttcatctggtctcttctcccccgcttcccacctcccaattcccgcgcagctcggctccgttccctcccactcccctaggcggaactgaaagcgaagatcagccaagagcacagtcggaggcggcagagacggtggcgggtgagctaggggctgtgagacgaagcagggagagagtgaacttcagccccgtcccctccccactgccacggctggggcaacccaacccgcgcctgaagcggcttggcttgacctgcggaagcgcgggccgggatggcgtggggagagggaggtaggtgccactgggctgcagatgacgagtgggttgggggcttgctgtgggacaagaggttcaggttccggcctgc

SEQ ID NO: 18 - DNA, 21 bp, Artificial Sequence
  synthetic oligonucleotide
accccgcgtgaagatgaaatg

SEQ ID NO: 19 - DNA, 21 bp, Artificial Sequence
  synthetic oligonucleotide
gagggataggargggaaatag

SEQ ID NO: 20 - DNA, 21 bp, Artificial Sequence
  synthetic oligonucleotide
ggatgtggatgcagatttgaa

SEQ ID NO: 21 - DNA, 21 bp, Artificial Sequence
  synthetic oligonucleotide
gctctgaatgatggccttctg

SEQ ID NO: 22 - DNA, 21 bp, Artificial Sequence
  synthetic oligonucleotide
tcctggatcagattcaagcac

SEQ ID NO: 23 - DNA, 21 bp, Artificial sequence
  synthetic oligonucleotide
gagggataggargggaaatag

SEQ ID NO: 24 - DNA, 21 bp, Artificial sequence
  synthetic oligonucleotide
ggatgtggatgcagatttgaa

SEQ ID NO: 25 - DNA, 21 bp, Artificial sequence
  synthetic oligonucleotide
gagggataggargggaaatag

SEQ ID NO: 26 - DNA, 22 bp, Artificial sequence
  synthetic oligonucleotide
gaaacaacgaatttcctccaaa

SEQ ID NO: 27 - DNA, 22 bp, Artificial sequence
  synthetic oligonucleotide
agtgaggctttccatcctttgc

SEQ ID NO: 28 - DNA, 22 bp, Artificial sequence
  synthetic oligonucleotide
attctttaagaaaactgtcagc

SEQ ID NO: 29 - DNA, 21 bp, Artificial sequence
  synthetic oligonucleotide
cacgggaaaggggtgcatgga

SEQ ID NO: 30 - DNA, 22 bp, Artificial sequence
  synthetic oligonucleotide
ggggtgcttcttttgggaggct

SEQ ID NO: 31 - DNA, 21 bp, Artificial sequence
  synthetic oligonucleotide
cacgggaaaggggtgcatgga

SEQ ID NO: 32 - DNA, 21 bp, Artificial sequence
  synthetic oligonucleotide
ggatgtggatgcagatttgaa

SEQ ID NO: 33 - DNA, 21 bp, Artificial sequence
  synthetic oligonucleotide
gtattgttttctgttccagtg

SEQ ID NO: 34 - DNA, 21 bp, Artificial sequence
  synthetic oligonucleotide
tgtgtttccgtacttggcttt

SEQ ID NO: 35 - DNA, 22 bp, Artificial sequence
  synthetic oligonucleotide
gcttagtcattcacatgatgaa

SEQ ID NO: 36 - DNA, 21 bp, Artificial sequence
  synthetic oligonucleotide
accaaaaatctcttgtgttct

SEQ ID NO: 37 - DNA, 21 bp, Artificial sequence
  synthetic oligonucleotide
ttcttggttcagggtatttgc

SEQ ID NO: 38 - DNA, 21 bp, Artificial sequence
  synthetic oligonucleotide
aacaaaaatgtcctgtgttct

SEQ ID NO: 39 - DNA, 21 bp, Artificial sequence
  synthetic oligonucleotide
ttcttggttcagggtatttgc

SEQ ID NO: 40 - DNA, 21 bp, Artificial sequence
  synthetic oligonucleotide
tgtccrcaattttgcacctgc

SEQ ID NO: 41 - DNA, 20 bp, Artificial sequence
  synthetic oligonucleotide
aggayagtgataccccaaca

SEQ ID NO: 42 - DNA, 21 bp, Artificial sequence
  synthetic oligonucleotide
agagcagattgtaacttcctg

SEQ ID NO: 43 - DNA, 21 bp, Artificial sequence
  synthetic oligonucleotide
gagggataggargggaaatag

SEQ ID NO: 44 - DNA, 22 bp, Artificial sequence
  synthetic oligonucleotide
cgtgacgaaacaggaagtgacc

SEQ ID NO: 45 - DNA, 22 bp, Artificial sequence
  synthetic oligonucleotide
gtagccaaggcccctgcatgtc

SEQ ID NO: 46 - DNA, 22 bp, Artificial sequence
  synthetic oligonucleotide
cgtgacgaaacaggaagtgacc

SEQ ID NO: 47 - DNA, 22 bp, Artificial sequence
  synthetic oligonucleotide
agccgaagacggtgacgcggtc

SEQ ID NO: 48 - DNA, 22 bp, Artificial sequence
  synthetic oligonucleotide
aggaagccggtcatggtttaca

SEQ ID NO: 49 - DNA, 22 bp, Artificial sequence
  synthetic oligonucleotide
acgctcagctccgtcgagtagt

SEQ ID NO: 50 - DNA, 22 bp, Artificial sequence
  synthetic oligonucleotide
agacgctcgtggcgctcttcac

SEQ ID NO: 51 - DNA, 22 bp, Artificial sequence
  synthetic oligonucleotide
gtagccaaggcccctgcatgtc

SEQ ID NO: 52 - DNA, 23 bp, Artificial sequence
  synthetic oligonucleotide
cctattgggctgatgctgtgacc

SEQ ID NO: 53 - DNA, 22 bp, Artificial sequence
  synthetic oligonucleotide
agggcacacaaccacatgcaag

SEQ ID NO: 54 - DNA, 22 bp, Artificial sequence
  synthetic oligonucleotide
ttgagctccaggttgagcaacc

SEQ ID NO: 55 - DNA, 22 bp, Artificial sequence
  synthetic oligonucleotide
ccccttgcgaagccagtcttcc

SEQ ID NO: 56 - DNA, 22 bp, Artificial sequence
  synthetic oligonucleotide
ctgcgtgctcattctctattcc

SEQ ID NO: 57 - DNA, 22 bp, Artificial sequence
  synthetic oligonucleotide
gtagaagagagctggccgattc

SEQ ID NO: 58 - DNA, 22 bp, Artificial sequence
  synthetic oligonucleotide
atggctatgtgtgacacgacag

SEQ ID NO: 59 - DNA, 22 bp, Artificial sequence
  synthetic oligonucleotide
ggaagatgagtgaaggggtacc

SEQ ID NO: 60 - DNA, 22 bp, Artificial sequence
  synthetic oligonucleotide
tttcctcatccagatagagtgg

SEQ ID NO: 61 - DNA, 22 bp, Artificial sequence
  synthetic oligonucleotide
catgtgttcctggatctgggag

SEQ ID NO: 62 - DNA, 4426 bp, Mus musculus
  misc_feature (2320)..(2320): n is a, g, t, or c
  misc_feature (2321)..(2321): n is a, g, t, or c
gcacgaggctgcgtgcggagcctgggcctcctcggccgccgcgcccgccccgccccccgtgacccccgtgaccccggggtcggaggccgcaggcaggccccgcccccacacaggaagtgggtggagaccaggtcgcccggcggccatgatggatccggagcggtgacgtcgcctggccccgccctaactcagcctacgctgtgattgacgggtggcctgccccaccccccccacgccgcggtgacgtcacaggaagtggcagggctgcggcaggaagtgttgcgctgagccagaagcggtcggaacggacaggaagtgacctcaccctaggcccgtggttgccgtgacgaaacaggaagtgacctcaggagggaccggaagtgaccgggtcacccacgaacccgcccacccgcgacaggaagtgaccgtgcagtcgcagggagcagccagggggcgaccggaagtgacgtcgccgtgacaggaagtgacgtcgccttgacaggaagtggctgcgtgaccggaagtgacgtcgccgtgaccggaagtggctgcgtgaccggaagtgacgtcgccgtgaccagatgtgacgtcgccgtgacaggaagtgacatcaccgtgacaggaagtctctgccggccgccatgcccgcccccgtccccgcccttttgtgcctcgccctcgccctggcatccgcccagccgtccccgccgccgccgccgccgttccccgtggtggccacgaactacgggaagctgcgcggggtgcgggcggcgctgccgggcgacgtgctgggccccgtgacgcagttcctgggcgtgccctacgcggccccgcccaccggcgagcgccgcttccagccgcccgagccgccgtcctcctgggccggcgtccgcgacgccacgcggttcgcgcccgtctgcccgcagcacctggacgagcgcgcgctgctgcgcgactgcctccccgcctggttcgccgccaacctcgacgccatcgccgccgacgtccaggaccagagcgaggactgcctgtacctcaacctctacgtgcccggcggagccaacggtaagaaaatggccgacgatgtcaccggcaacgaccacggtgacgaccaagactcccgtgaccccggcgtgggcggcgcggcggcggcggcggcgaggaagccggtcatggtttacatccacggcggctcctacatggagggcaccgcgaacatcgtggacggcagcgtcctcgccagctacggcgacgtcatcgtcgtcaccgtcaactaccggctcggcgtgctcggcttccagagcacgggcgaccaggccgccaagggcaactacgggctgctggaccagatccaggcgctgcgctgggtggaggagaacgcgggcgccttcggcggggaccccgaccgcgtcaccgtcttcggctccggcgccggcgcctcctgcgtcagcctcctcacgctgtcgcactactcggagggcctgttccagaaggccatcatccagagcgggacggcgctgtcgagctgggcggtgaactaccagccggcccggtacgcgcgggcgctgggcgagcgcgtgggctgcgcgacccccgacccggggtcgccgccggggtcgccgccgggttgggactcggcgtcgctggtgtcctgcctgcggggcaaggcggcgggcgagctggcgcgggcccgcgtgacgcccgcgacctaccacgtggcgttcgggccgacggtggacggcgacgtcatccccgacgacccccagatcctgatggagcagggcgagttcctcaactacgacatcatgctcggcgtcaaccagggcgagggcgcgcgcttcgtcgacggcctcggcggcggccacgacggcggctacggcggatacggcggcgggtacggcggcggcgtcgaggacgacgaggtccaagatggcggcccggacggcgccgcgggcggcgtgtcggcgggcgagttcgacctggcggtgtccggcttcatcaacgacctctacggccgccccgagggccgcggcgacgccctgcgcgagacggtgaagttcatgtacaccgactgggccgaccgcgacagccccgaggcgcggcgcaagacgctcgtggcgctcttcaccgaccaccagtgggtggcgcccgccgtggccaccgccgacctccacgcccgctacggctcccccacctacttctacgccttctaccaccggtgccacgcggcgtcccgcggtgatgacgtcgtcgtcgatggcgtcgggctcggggatgacgtcgtcgtccggctcggggatgacgtcgtcgtcggggtagnntcggcgtccgcggtgctgatcgagacgcggcgcgactactcgacggagctgagcgtgacgatcgcggtgggggcctcgctgctcttcctcaacgtcctcgccttcgccgcgctctactacaagaaggacaagcgccggcacgagacgcaccgcaggccgcccccgccacgccccccgcaggccccgccctccgccgccgccgccgaccggaacccgcgacccgaccccgggccggccggccggcgtggcggggagtgcggtgcagtggtcaccgcgatggcggcggaggcgtcggcgggcggcctgggccacgacggcgtcggcggggtcggggtcggcggggtcatcggcggggtcgccggcctgcgcctggcctgcccgcccgactacgcgctgaccctgcggcgctcgcccgacgacgtcccccgggccggggccgggccgggcgccatgacgctcatccccggggcgctgggtggaggcggcggcggcgccgtgcacgggttcaacacctttgggagcggggtcggcgtcgccggggtcgccggggtcgcgacctcgcaggccgggccggggctgccccacggacactcgaccacccgggtatagcgtggcgagcgcgggagcttggcgggggcggagcgtggactcctgtgaagccccgcccacccggcccaaaagccccgccccgcccggcgaggccccgcccacagccgcggacatgcaggggccttggctacggcaggcgatgacgtcaccgccctgaccacgcccccttccccgtcgcgggacatgaggtcgactgaggggcggagtcagggcagtgggtggggtccggatggtaacggggaaccggatagaaccggatgggaccgcattgatccggagggaaccggatggaactggattgagccgggtcagcacgggttggactggattgaaccggattaatccggatggagccggtgatgccaggcctgagctgagcagcctggtgtgggcggaaccggatgagaccggataaaaccggcctgaacccgcgcgcgcgaccagcaccgagctggtcgatgtggaccaaacctgaatggaccggattggaccgggctacgccggctggatccggatccgactgggcgggaccgagaccggatgggaccggatggaaccggttcagaccgggctcggctggatcagactggacggagggggttggcgcggaccaaggcaagggcgccgggtcggacctgacgcagccggacaagaccggttcggaccaggcggaaccggattgggctgtgtccctgtgggcagaaccggattttactggattttaccggatgggacaggaatggacgagagcagcgtgaactgcatgaaaccgctttagaccggaatgaaccggaatgaaccggatcaagtgggagaccggatggcatccagggcactggacagatccggactgaactggaacggaccggatcgatccggatgggaccggatggagccgcgtcgcctcgcacggccccgggcacgcggacggcggacattttacattttatcgtcaatgacgctcacggccgcgagtgaggtcatcggggagcggtgggggatggaggggggcggagtcttattttttattagaattcggatcgcgtcgtttcctccctggcgcccgacagagccgggtgcgcggttgccgccacgattctatctttcctcatttttaattttatttctatttatttttggttatatttttaattttttattatactttttatttattgtgtatctttatttttaaattatttttagcgccgcgtcggcgcaccgacgtttccggattttttgttatatgttaaatgacccagatttgaaacttaattttgttacagtgtcacgtttacattgatattaggggctaaaataatttgtatgtccacgttgaaaagtgagaccttggaaattcgggggaaacttctagtttgcagagatctgtgagaagaggtgggatctcaagggttcaatgttgggcaaattctgtgtaaacggatttagatgtatggtagattaacgttcgcctttattggagagttaatatagag

SEQ ID NO: 63 - protein, 762 aa, Mus musculus
  misc_feature (560)..(560): Xaa is any amino acid
MPAPVPALLCLALALASAQPSPPPPPPFPVVATNYGKLRGVRAALPGDVLGPVTQFLGVPYAAPPTGERRFQPPEPPSSWAGVRDATRFAPVCPQHLDERALLRDCLPAWFAANLDAIAADVQDQSEDCLYLNLYVPGGANGKKMADDVTGNDHGDDQDSRDPGVGGAAAAAARKPVMVYIHGGSYMEGTANIVDGSVLASYGDVIVVTVNYRLGVLGFQSTGDQAAKGNYGLLDQIQALRWVEENAGAFGGDPDRVTVFGSGAGASCVSLLTLSHYSEGLFQKAIIQSGTALSSWAVNYQPARYARALGERVGCATPDPGSPPGSPPGWDSASLVSCLRGKAAGELARARVTPATYHVAFGPTVDGDVIPDDPQILMEQGEFLNYDIMLGVNQGEGARFVDGLGGGHDGGYGGYGGGYGGGVEDDEVQDGGPDGAAGGVSAGEFDLAVSGFINDLYGRPEGRGDALRETVKFMYTDWADRDSPEARRKTLVALFTDHQWVAPAVATADLHARYGSPTYFYAFYHRCHAASRGDDVVVDGVGLGDDVVVRLGDDVVVGVXSASAVLIETRRDYSTELSVTIAVGASLLFLNVLAFAALYYKKDKRRHETHRRPPPPRPPQAPPSAAAADRNPRPDPGPAGRRGGECGAVVTAMAAEASAGGLGHDGVGGVGVGGVIGGVAGLRLACPPDYALTLRRSPDDVPRAGAGPGAMTLIPGALGGGGGGAVHGFNTFGSGVGVAGVAGVATSQAGPGLPHGHSTTRV

SEQ ID NO: 64 - protein, 822 aa, Homo sapiens
ALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 65 - protein, 835 aa, Homo sapiens
MWLLALCLVGLAGAQRGGGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPAGAPGTRRPPPPATLPPEPEPEPGPRAYDRFPGDSRDYSTELSVTVAVGASLLFLNILAFAALYYKRDRRQELRCRRLSPPGGSGSGVPGGGPLLPAAGRELPPEEELVSLQLKRGGGVGADPAEALRPACPPDYTLALRRAPDDVPLLAPGALTLLPSGLGPPPPPPPPSLHPFGPFPPPPPTATSHNNTLPHPHSTTRV

SEQ ID NO: 66 - protein, 828 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPYWSGIRNATHFPPVCPQNIHTAVPEVMLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASILFLNVLAFAALYYRKDKRRQEPLRQPSPQRGAWAPELGAAPEEELAALQLGPTHHECEASPPHDTLRLTALPDYTLTLRRSPDDIPLMTPNTITMIPNSLVGLQTLHPYNTFAAGFNSTGLPHSHSTTRV

SEQ ID NO: 67 - protein, 815 aa, Homo sapiens
SRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 68 - protein, 43 aa, Artificial Sequence; identical to SEQ ID NO: 10
  variant sequence

SEQ ID NO: 69 - protein, 43 aa, Homo sapiens
PEGKDTLRETIKFMYTDWADRDNPETRRKTLVALFTDHQWVEP

SEQ ID NO: 70 - protein, 43 aa, Bos taurus
PEFKDTLRETIKFMYTDWADRDNPETRRKTLVALFTDHQWVEP

SEQ ID NO: 71 - protein, 43 aa, Rattus rattus; identical to SEQ ID NO: 69

SEQ ID NO: 72 - protein, 43 aa, Mus musculus; identical to SEQ ID NO: 69

SEQ ID NO: 73 - protein, 42 aa, Drosophila melanogaster
HLNEIFAVLKNEYTDWEKAIRNPLSSRDATLQFLSDGHTASP

SEQ ID NO: 74 - protein, 43 aa, Drosophila melanogaster
TLNPNGVYEAIKYIYTFWPDPNNNTIIRDQYINMLSDLYYRAP

SEQ ID NO: 75 - protein, 43 aa, Homo sapiens
PQVSDLAAEAVVLHYTDWLHPEDPARLREALSDVVGDHNVVCP

SEQ ID NO: 76 - protein, 43 aa, Bos taurus
PQASDLAAEAVVLHYTDWLHPEDPARLREALSDVVGDHNVVCP

SEQ ID NO: 77 - protein, 43 aa, Oryctolagus cuniculus
PQASDLAAEAVVLHYTDWLHPEDPARLRDALSDVVGDHNVVCP

SEQ ID NO: 78 - protein, 43 aa, Felis catus
PQASDLAAEAVVLHYTDWLNPEDPARLREAMSDVVGDHNVVCP

SEQ ID NO: 79 - protein, 43 aa, Mus musculus
PQASDLAAEAVVLHYTDWLHPEDPTHLRDAMSAVVGDHNVVCP

SEQ ID NO: 80 - protein, 43 aa, Rattus rattus; identical to SEQ ID NO: 79

SEQ ID NO: 81 - protein, 43 aa, Gallus gallus
PQATELAAEAVVLHYTDWLDADNPVKNREALDDIVGDHNVVCP

SEQ ID NO: 82 - protein, 42 aa, Thamnophis sp.
PHANDIATDAVVLQYTDWQDQNREKNREALDDIVGDHNVICP

SEQ ID NO: 83 - protein, 42 aa, Electrophorus sp.
PHANEIGLEAVILQYTDWDEDNPIKNREAMDDIVGDHNVVCP

SEQ ID NO: 84 - protein, 43 aa, Torpedo sp.
PHANDLGLDAVTLQYTDWMDDNNGIKNRDGLDDIVGDHNVICP

SEQ ID NO: 85 - protein, 43 aa, Equus burchelli
PHANDIGLEAVILQYTDWMDENNGQKNRDAMDDIVGDQNVICP

SEQ ID NO: 86 - protein, 44 aa, Myxine glutinosa
PQGNEVSVDAIVLQYTDWLANQNDALKNRDAIEDIVGDYNVICP

SEQ ID NO: 87 - protein, 43 aa, Amphoxius sp.
PRLNDITVERTAFEYTDWLHMDQDTMYRDALDSVFGDPFFVCP

SEQ ID NO: 88 - protein, 43 aa, Aphis gossypii
PNADAAVKSAIEFEYTDWFNPNDPEKNRNALDKMVGDYQFTCN

SEQ ID NO: 89 - protein, 43 aa, Homo sapiens
PGVSEFGKESILFHYTDWVDDQRPENYREALGDVVGDYNFICP

SEQ ID NO: 90 - protein, 43 aa, Mus musculus
PGVSRLGKEAVLFYYVDWLGEQSPEVYRDALDDVIGDYNIICP

SEQ ID NO: 91 - protein, 43 aa, Equus sp.
PRVSEFGRESILFHYMDWLDDQRAENYREALDDVVGDYNIICP

SEQ ID NO: 92 - protein, 43 aa, Oryctolagus cuniculus
PGVSEFGKESILFHYTDWVDEQRPENYREALDDVVGDYNFICP

SEQ ID NO: 93 - protein, 39 aa, Artificial Sequence; identical to SEQ ID NO: 11
  variant sequence

SEQ ID NO: 94 - protein, 39 aa, Homo sapiens
PDDIPLMTPNTITMIPNSLVGLQTLHPYNTFAAGFNSTG

SEQ ID NO: 95 - protein, 31 aa, Bos taurus
PNTITIIPNSLVGLQTLHPYNTFAAGFNSTG

SEQ ID NO: 96 - protein, 39 aa, Rattus rattus; identical to SEQ ID NO: 94

SEQ ID NO: 97 - protein, 39 aa, Mus musculus; identical to SEQ ID NO: 94

SEQ ID NO: 98 - protein, 38 aa, Danio rerio
PDDIPLMTPNTITMIPNSMPGLTSLHPFNSYSSGQNNT

The invention claimed is:

1. A method of diagnosing autism linked to a mutation in the polynucleotide of SEQ ID NO: 12 or the polypeptide of SEQ ID NO: 14, or a propensity therefor, in a human, wherein said mutation results in altered synapse formation, wherein said method comprises (a) detecting a mutation in
(i) the polynucleotide of SEQ ID NO: 12, wherein said mutation results in a mutation in the polypeptide encoded thereby at position 451 or 796, or a combination thereof, or
(ii) the polypeptide of SEQ ID NO: 14, wherein said mutation is at position 451 or 796, or a combination thereof,
wherein said detecting comprises comparing the sequence of the polynucleotide or polypeptide obtained from said human with the polynucleotide of SEQ ID NO: 12 or the polypeptide of SEQ ID NO: 14 and identifying mutations in said polynucleotide or polypeptide from said human; and
(b) correlating said mutations in said polynucleotide or polypeptide from said human with a autism or a propensity for autism.

2. The method as claimed in claim 1, wherein said polynucleotide or polypeptide obtained from said human is obtained by amplifying a polynucleotide, in its wild-type (nonmutated) form, of SEQ ID NO: 12, amplifying a fragment of said polynucleotide or amplifying a messenger RNA of said polynucleotide.

3. The method as claimed in claim 1, wherein said polynucleotide or polypeptide obtained from said human is obtained by amplifying a polynucleotide encoding, in its wild-type (nonmutated) form, a polypeptide of SEQ ID NO: 14, amplifying a fragment of said polynucleotide or amplifying a messenger RNA of said polynucleotide.

4. The method as claimed in claim 1, wherein said detecting comprises detecting a mutation in the polynucleotide of SEQ ID NO: 12, wherein said mutation results in a mutation in the polypeptide encoded thereby at position 451.

5. The method as claimed in claim 4, wherein said mutation at position 451 is a substitution of an arginine with a cysteine.

6. The method as claimed in claim 5, wherein said detecting further comprises detecting a mutation in the polynucleotide of SEQ ID NO: 12, wherein said mutation results in a mutation in the polypeptide encoded thereby at position 796.

7. The method as claimed in claim 6, wherein said mutation at position 796 is a substitution of an asparagine with a serine.

8. The method as claimed in claim 1, wherein said detecting comprises detecting a mutation in the polynucleotide of SEQ ID NO: 12, wherein said mutation results in a mutation in the polypeptide encoded thereby at position 796.

9. The method as claimed in claim 8, wherein said mutation at position 796 is a substitution of an asparagine with a serine.

10. The method as claimed in claim 1, wherein said detecting comprises detecting a mutation in the polypeptide of SEQ ID NO: 14, wherein said mutation is at position 451.

11. The method as claimed in claim 10, wherein said mutation at position 451 is a substitution of an arginine with a cysteine.

12. The method as claimed in claim 10, wherein said detecting further comprises detecting a mutation in the polypeptide of SEQ ID NO: 14, wherein said mutation is at position 796.

13. The method as claimed in claim 12, wherein said mutation at position 796 is a substitution of an asparagine with a serine.

14. The method as claimed in claim 1, wherein said detecting comprises detecting a mutation in the polypeptide of SEQ ID NO: 14, wherein said mutation is at position 796.

15. The method as claimed in claim 14, wherein said mutation at position 796 is a substitution of an asparagine with a serine.

* * * * *